United States Patent
Verweij et al.

(10) Patent No.: US 12,123,001 B2
(45) Date of Patent: Oct. 22, 2024

(54) METHODS OF TREATING LIVER DISEASES WITH PHOSPHODIESTERASE 3B (PDE3B) INHIBITORS

(71) Applicant: Regeneron Pharmaceuticals, Inc., Tarrytown, NY (US)

(72) Inventors: Niek Verweij, Tarrytown, NY (US); Olukayode Sosina, Tarrytown, NY (US); Parsa Akbari, Tarrytown, NY (US); Adam Locke, Tarrytown, NY (US); Aris Baras, Tarrytown, NY (US); Luca Andrea Lotta, Tarrytown, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 193 days.

(21) Appl. No.: 17/740,382

(22) Filed: May 10, 2022

(65) Prior Publication Data

US 2022/0364099 A1 Nov. 17, 2022

Related U.S. Application Data

(60) Provisional application No. 63/186,838, filed on May 11, 2021.

(51) Int. Cl.
*C12N 15/113* (2010.01)
*A61P 1/16* (2006.01)
*A61P 3/10* (2006.01)
*C12Q 1/6883* (2018.01)

(52) U.S. Cl.
CPC ............ *C12N 15/1137* (2013.01); *A61P 1/16* (2018.01); *A61P 3/10* (2018.01); *C12Q 1/6883* (2013.01); *C12N 2310/11* (2013.01); *C12N 2310/14* (2013.01); *C12N 2310/531* (2013.01); *C12N 2320/30* (2013.01); *C12Q 2600/106* (2013.01); *C12Q 2600/156* (2013.01)

(58) Field of Classification Search
CPC ............ C12N 15/1137; C12N 2310/11; C12N 2310/14; C12N 2310/531; C12N 2320/30; C12N 2310/20; C12N 2320/34; A61P 1/16; A61P 3/10; C12Q 1/6883; C12Q 2600/106; C12Q 2600/156; A61K 31/7088; A61K 31/7105; A61K 45/06; C12Y 301/04017
USPC ...................................................... 514/44 A
See application file for complete search history.

(56) References Cited

U.S. PATENT DOCUMENTS

2007/0249668 A1* 10/2007 Sprague ............. A61P 3/00
424/94.1

FOREIGN PATENT DOCUMENTS

| JP | 2009242378 | 10/2009 | |
|---|---|---|---|
| WO | 2002070469 | 9/2002 | |
| WO | WO-2005030787 A2 * | 4/2005 | ............. C07H 21/00 |
| WO | 2009008539 | 1/2009 | |
| WO | 2011111066 | 9/2011 | |
| WO | 2016079652 | 5/2016 | |
| WO | 2020010181 | 1/2020 | |
| WO | WO-2020010181 A1 * | 1/2020 | ......... A61K 31/4709 |
| WO | 2021160131 | 8/2021 | |

OTHER PUBLICATIONS

Amarapurkar DN. Prescribing medications in patients with decompensated liver cirrhosis. Int J Hepatol. 2011;2011:519526 (Year: 2011).*
Tang Y.et al., Improvement in insulin resistance and the restoration of reduced phosphodiesterase 3B gene expression by pioglitazone in adipose tissue of obese diabetic KKAy mice.Diabetes. 1999; 48: 1830-1835 (Year: 1999).*
Berger, K., et al., (2009). Phosphodiesterase 3B is localized in caveolae and smooth ER in mouse hepatocytes and is important in the regulation of glucose and lipid metabolism. PloS one, 4(3), e4671 (Year: 2009).*
Choi YH, et al., Alterations in regulation of energy homeostasis in cyclic nucleotide phosphodiesterase 3B-null mice. J Clin Invest. Dec. 2006;116(12):3240-51 (Year: 2006).*
Emdin, C.A., Khera, A.V., Chaffin, M. et al. Analysis of predicted loss-of-function (pLOF) variants in UK Biobank identifies variants protective for disease. Nat Commun 9, 1613 (2018) (Year: 2018).*
Movsesian M, Ahmad F, Hirsch E. Functions of PDE3 Isoforms in Cardiac Muscle. J Cardiovasc Dev Dis. Feb. 6, 2018;5(1):10. (Year : 2018).*
Oh, Y. J., et al., (2018). Cilostazol Improves HFD-Induced Hepatic Steatosis by Upregulating Hepatic STAMP2 Expression through AMPK. Molecular pharmacology, 94(6), 1401-1411 (Year: 2018).*
Klarin, D., Damrauer, S.M., Cho, K. et al. Genetics of blood lipids among ~300,000 multi-ethnic participants of the Million Veteran Program. Nat Genet 50, 1514-1523 (2018) (Year: 2018).*
Chung et al., Targeted disruption of PDE3B, but not PDE3A, protects murine heart from ischemia/reperfusion injury, 2015, Proceedings of the National Academy of Sciences E2253-E2262, 112, 17 (Year: 2015).*
Guo et al., "Effects of Chinese Medicinal Formula BNG-1 on Phosphodiesterase 3B Expression, Hepatic Steatosis, and Insulin Resistance in High Fat Diet-induced NAFLD Mice", International Journal of Medical Science, 2018, 15(11), pp. 1194-1202.
An et al., "The Loss-of-Function S267F Variant in HBV Receptor NTCP Reduces Human Risk for HBV Infection and Disease Progression", Journal of Infectious Diseases, 2018, 218(9), pp. 1404-1410.
Scott et al., "Genetics of alcoholic liver disease and non-alcoholic steatohepatitis", Clinical Medicine, 2018, 17(18), pp. s54-s59.
Klarin et al., "Genetics of blood lipids among ~300,000 multi-ethnic participants of the Million Veteran Program", Nature Genetics, 2018, 50(11), pp. 1514-1523.

* cited by examiner

Primary Examiner — Neil P Hammell
Assistant Examiner — Shabana S Meyering
(74) Attorney, Agent, or Firm — Armstrong Teasdale LLP

(57) ABSTRACT

The present disclosure provides methods of treating a subject having a liver disease or type 2 diabetes, and methods of identifying subjects having an increased risk of developing a liver disease or type 2 diabetes.

14 Claims, No Drawings

Specification includes a Sequence Listing.

METHODS OF TREATING LIVER DISEASES WITH PHOSPHODIESTERASE 3B (PDE3B) INHIBITORS

REFERENCE TO SEQUENCE LISTING

This application includes a Sequence Listing submitted electronically as a text file named 18923806901SEQ, created on May 9, 2022, with a size of 1,081,598 bytes. The Sequence Listing is incorporated herein by reference.

FIELD

The present disclosure relates generally to the treatment of subjects having a liver disease with Phosphodiesterase 3B (PDE3B) inhibitors, and methods of identifying subjects having an increased risk of developing a liver disease.

BACKGROUND

Chronic liver disease and cirrhosis are leading causes of morbidity and mortality in the United States accounting for 38,170 deaths (1.5% of total deaths) in 2014 (Kochanek et al., Nat'l. Vital Stat. Rep., 2016, 65, 1-122). The most common etiologies of cirrhosis in the U.S. are alcoholic liver disease, chronic hepatitis C, and nonalcoholic fatty liver disease (NAFLD), together accounting for about 80% of subjects awaiting liver transplant between 2004 and 2013 (Wong et al., Gastroenterology, 2015, 148, 547-555). The estimated prevalence of NAFLD in the U.S. is between 19 and 46 percent (Browning et al., Hepatology, 2004, 40, 1387-1395; Lazo et al., Am. J. Epidemiol., 2013, 178, 38-45; and Williams et al., Gastroenterology, 2011, 140, 124-131) and is rising over time (Younossi et al., Clin. Gastroenterol. Hepatol., 2011, 9, 524-530), likely in conjunction with increased rates of obesity, its primary risk factor (Cohen et al., Science, 2011, 332, 1519-1523). While significant advances have been made in the treatment of hepatitis C, there are currently no evidence-based treatments for alcoholic or nonalcoholic liver disease and cirrhosis.

The global epidemic of Type 2 diabetes (T2D) is a major public health problem, as this disease is the fifth leading cause of death worldwide and a leading cause of morbidity, premature coronary heart disease, stroke, peripheral vascular disease, renal failure, and amputation. The number of individuals living with diabetes worldwide is predicted to increase from 366 million in 2011 to 552 million by 2030.

T2D is characterized by hyperglycemia due to impaired insulin secretion and insulin resistance in target tissues. T2D is typically diagnosed after age 40 years and is caused by the combined action of genetic susceptibility and environmental factors. T2D is associated with obesity, and it is also a polygenic disease.

Phosphodiesterase 3B (PDE3B) is a member of a family of phosphohydrolyases that catalyze the hydrolysis of 3' cyclic phosphate bonds in adenosine and/or guanine 3',5' cyclic monophosphate (cAMP and/or cGMP), which results in the formation of the respective nucleoside 5' monophosphates. The cyclic nucleotides cAMP and cGMP serve as second messengers in a number of cellular signaling pathways. The PDEs as well as the guanylyl and adenylyl cyclases, which synthesize the cyclic nucleotides, are cellular components to regulate the concentration of cyclic nucleotides and, thus, to regulate the signal transduction pathways. In particular, PDEs regulate the second messengers by controlling their degradation.

SUMMARY

The present disclosure provides methods of treating a subject having a liver disease, or having a risk for developing a liver disease, or who have risk factors for developing a liver disease, or who have a risk of developing complications of a liver disease, the methods comprising administering a PDE3B inhibitor to the subject.

The present disclosure also provides methods of treating a subject having a fatty liver disease, or having a risk for developing a fatty liver disease, or who have risk factors for developing a fatty liver disease, or who have a risk of developing complications of a fatty liver disease, the methods comprising administering a PDE3B inhibitor to the subject.

The present disclosure also provides methods of treating a subject having hepatocellular carcinoma, or having a risk for developing hepatocellular carcinoma, or who have risk factors for developing hepatocellular carcinoma, or who have a risk of developing complications of hepatocellular carcinoma, the methods comprising administering a PDE3B inhibitor to the subject.

The present disclosure also provides methods of treating a subject having liver cirrhosis, or having a risk for developing liver cirrhosis, or who have risk factors for developing liver cirrhosis, or who have a risk of developing complications of liver cirrhosis, the methods comprising administering a PDE3B to the subject.

The present disclosure also provides methods of treating a subject having liver fibrosis, or having a risk for developing liver fibrosis, or who have risk factors for developing liver fibrosis, or who have a risk of developing complications of liver fibrosis, the methods comprising administering a PDE3B inhibitor to the subject.

The present disclosure also provides methods of treating a subject having simple steatosis, steatohepatitis, or non-alcoholic steatohepatitis (NASH), or having a risk for developing simple steatosis, steatohepatitis, or NASH, or who have risk factors for developing simple steatosis, steatohepatitis, or NASH, or who have a risk of developing complications of simple steatosis, steatohepatitis, or NASH, the methods comprising administering a PDE3B inhibitor to the subject.

The present disclosure also provides methods of treating a subject having a liver injury, or having a risk for developing a liver injury, or who have risk factors for developing a liver injury, or who have a risk of developing complications of a liver injury, the methods comprising administering a PDE3B inhibitor to the subject.

The present disclosure also provides methods of treating a subject having type 2 diabetes, or having a risk for developing type 2 diabetes, or who have risk factors for developing type 2 diabetes, or who have a risk of developing complications of type 2 diabetes, the methods comprising administering a PDE3B inhibitor to the subject.

The present disclosure also provides methods of treating a subject with a therapeutic agent that treats or inhibits a liver disease or type 2 diabetes, wherein the subject is suffering from a liver disease or type 2 diabetes, the methods comprising the steps of: determining whether the subject has a PDE3B predicted loss-of-function or missense variant nucleic acid molecule encoding a human PDE3B polypeptide by: obtaining or having obtained a biological sample from the subject; and performing or having performed a sequence analysis on the biological sample to determine if the subject has a genotype comprising the PDE3B predicted loss-of-function or missense variant nucleic acid molecule;

when the subject is heterozygous for a PDE3B predicted loss-of-function or missense variant nucleic acid molecule, then administering or continuing to administer to the subject the therapeutic agent that treats or inhibits the liver disease or type 2 diabetes in an amount that is the same as or less than a standard dosage amount, and administering to the subject a PDE3B inhibitor; and when the subject is homozygous for a PDE3B predicted loss-of-function or missense variant nucleic acid molecule, then administering or continuing to administer to the subject the therapeutic agent that treats or inhibits the liver disease or type 2 diabetes in an amount that is the same as or less than a standard dosage amount; and when the subject is PDE3B reference, then administering or continuing to administer to the subject the therapeutic agent that treats or inhibits the liver disease or type 2 diabetes in an amount that is greater than a standard dosage amount, and administering to the subject a PDE3B inhibitor; wherein the presence of a genotype having the PDE3B predicted loss-of-function or missense variant nucleic acid molecule encoding the human PDE3B polypeptide indicates the subject has a decreased risk of developing the liver disease or type 2 diabetes.

The present disclosure also provides methods of identifying a subject having an increased risk of developing a liver disease or type 2 diabetes, wherein the methods comprise: determining or having determined the presence or absence of a PDE3B predicted loss-of-function or missense variant nucleic acid molecule encoding a human PDE3B polypeptide in a biological sample obtained from the subject; wherein: when the subject is PDE3B reference, then the subject has an increased risk of developing the liver disease or type 2 diabetes; and when the subject is heterozygous or homozygous for a PDE3B predicted loss-of-function or missense variant, then the subject has a decreased risk of developing the liver disease or type 2 diabetes.

The present disclosure also provides therapeutic agents that treat or inhibit a liver disease or type 2 diabetes for use in the treatment of the liver disease or type 2 diabetes in a subject that is PDE3B reference (in an amount that is greater than a standard dosage amount) or that has: a Phosphodiesterase 3B (PDE3B) predicted loss-of-function or missense variant genomic nucleic acid molecule encoding a PDE3B polypeptide; a PDE3B predicted loss-of-function or missense variant mRNA molecule encoding a PDE3B polypeptide; or a PDE3B predicted loss-of-function or missense variant cDNA molecule encoding a PDE3B polypeptide (in an amount that is less than or the same as a standard dosage amount).

The present disclosure also provides PDE3B inhibitors that treat or inhibit a liver disease or type 2 diabetes for use in the treatment of the liver disease or type 2 diabetes in a subject that is PDE3B reference or that is heterozygous for: a PDE3B predicted loss-of-function or missense variant genomic nucleic acid molecule encoding a PDE3B polypeptide; a PDE3B predicted loss-of-function or missense variant mRNA molecule encoding a PDE3B polypeptide; or a PDE3B predicted loss-of-function or missense variant cDNA molecule encoding a PDE3B polypeptide.

DESCRIPTION

Various terms relating to aspects of the present disclosure are used throughout the specification and claims. Such terms are to be given their ordinary meaning in the art, unless otherwise indicated. Other specifically defined terms are to be construed in a manner consistent with the definitions provided herein.

Unless otherwise expressly stated, it is in no way intended that any method or aspect set forth herein be construed as requiring that its steps be performed in a specific order. Accordingly, where a method claim does not specifically state in the claims or descriptions that the steps are to be limited to a specific order, it is in no way intended that an order be inferred, in any respect. This holds for any possible non-expressed basis for interpretation, including matters of logic with respect to arrangement of steps or operational flow, plain meaning derived from grammatical organization or punctuation, or the number or type of aspects described in the specification.

As used herein, the singular forms "a," "an" and "the" include plural referents unless the context clearly dictates otherwise.

As used herein, the term "about" means that the recited numerical value is approximate and small variations would not significantly affect the practice of the disclosed embodiments. Where a numerical value is used, unless indicated otherwise by the context, the term "about" means the numerical value can vary by ±10% and remain within the scope of the disclosed embodiments.

As used herein, the term "comprising" may be replaced with "consisting" or "consisting essentially of" in particular embodiments as desired.

As used herein, the term "isolated", in regard to a nucleic acid molecule or a polypeptide, means that the nucleic acid molecule or polypeptide is in a condition other than its native environment, such as apart from blood and/or animal tissue. In some embodiments, an isolated nucleic acid molecule or polypeptide is substantially free of other nucleic acid molecules or other polypeptides, particularly other nucleic acid molecules or polypeptides of animal origin. In some embodiments, the nucleic acid molecule or polypeptide can be in a highly purified form, i.e., greater than 95% pure or greater than 99% pure. When used in this context, the term "isolated" does not exclude the presence of the same nucleic acid molecule or polypeptide in alternative physical forms, such as dimers or Alternately phosphorylated or derivatized forms.

As used herein, the terms "nucleic acid", "nucleic acid molecule", "nucleic acid sequence", "polynucleotide", or "oligonucleotide" can comprise a polymeric form of nucleotides of any length, can comprise DNA and/or RNA, and can be single-stranded, double-stranded, or multiple stranded. One strand of a nucleic acid also refers to its complement.

As used herein, the term "subject" includes any animal, including mammals. Mammals include, but are not limited to, farm animals (such as, for example, horse, cow, pig), companion animals (such as, for example, dog, cat), laboratory animals (such as, for example, mouse, rat, rabbits), and non-human primates. In some embodiments, the subject is a human. In some embodiments, the human is a patient under the care of a physician.

It has been observed in accordance with the present disclosure that loss-of-function variants in PDE3B (whether these variations are homozygous or heterozygous in a particular subject) associate with a decreased risk of developing a liver disease or type 2 diabetes. It is believed that loss-of-function variants in the PDE3B gene or protein have not been associated with liver diseases or type 2 diabetes in genome-wide or exome-wide association studies. Therefore, subjects that are PDE3B reference or heterozygous for PDE3B variant nucleic acid molecules may be treated with a PDE3B inhibitor such that a liver disease or type 2 diabetes is inhibited, the symptoms thereof are reduced, and/or development of symptoms is repressed. It is also believed that such subjects having liver diseases or type 2 diabetes may further be treated with therapeutic agents that treat or inhibit a liver disease or type 2 diabetes.

For purposes of the present disclosure, any particular subject, such as a human, can be categorized as having one of three PDE3B genotypes: i) PDE3B reference; ii) heterozygous for a predicted loss-of-function or missense variant PDE3B nucleic acid molecule; or iii) homozygous for a predicted loss-of-function or missense variant PDE3B nucleic acid molecule. A subject is PDE3B reference when the subject does not have a copy of a PDE3B predicted loss-of-function or missense variant nucleic acid molecule. A subject is heterozygous for a PDE3B predicted loss-of-function or missense variant when the subject has a single copy of a PDE3B predicted loss-of-function or missense variant nucleic acid molecule. A PDE3B predicted loss-of-function or missense variant nucleic acid molecule is any nucleic acid molecule (such as, a genomic nucleic acid molecule, an mRNA molecule, or a cDNA molecule) encoding a variant PDE3B polypeptide having a partial loss-of-function, a complete loss-of-function, a predicted partial loss-of-function, or a predicted complete loss-of-function. A subject who has a PDE3B polypeptide having a partial loss-of-function (or predicted partial loss-of-function) is hypomorphic for PDE3B. A subject is homozygous for a PDE3B predicted loss-of-function or missense variant nucleic acid molecule when the subject has two copies (same or different) of a PDE3B predicted loss-of-function or missense variant nucleic acid molecule.

For subjects that are genotyped or determined to be PDE3B reference, such subjects have an increased risk of developing type 2 diabetes or a liver disease, such as, liver injury, liver cirrhosis, liver fibrosis, steatosis, steatohepatitis, or non-alcoholic steatohepatitis (NASH), liver inflammation, and/or fatty liver disease. For subjects that are genotyped or determined to be either PDE3B reference or heterozygous for a PDE3B predicted loss-of-function or missense variant, such subjects or subjects can be treated with a PDE3B inhibitor.

In any of the embodiments described herein, the PDE3B predicted loss-of-function or missense variant nucleic acid molecule can be any nucleic acid molecule (such as, for example, genomic nucleic acid molecule, mRNA molecule, or cDNA molecule) encoding a PDE3B variant polypeptide having a partial loss-of-function, a complete loss-of-function, a predicted partial loss-of-function, or a predicted complete loss-of-function. In some embodiments, the PDE3B predicted loss-of-function or missense variant nucleic acid molecule is associated with a reduced in vitro response to PDE3B ligands compared with reference PDE3B. In some embodiments, the PDE3B predicted loss-of-function or missense variant nucleic acid molecule is a PDE3B variant that results or is predicted to result in a premature truncation of a PDE3B polypeptide compared to the human reference genome sequence. In some embodiments, the PDE3B predicted loss-of-function or missense variant nucleic acid molecule is a variant that is predicted to be damaging by in vitro prediction algorithms such as Polyphen, SIFT, or similar algorithms. In some embodiments, the PDE3B predicted loss-of-function or missense variant nucleic acid molecule is a variant that causes or is predicted to cause a nonsynonymous amino-acid substitution in PDE3B and whose allele frequency is less than 1/100 alleles in the population from which the subject is selected. In some embodiments, the PDE3B predicted loss-of-function or missense variant nucleic acid molecule is any rare missense variant (allele frequency <0.1%; or 1 in 1,000 alleles), or any splice-site, stop-gain, start-loss, stop-loss, frameshift, or in-frame indel, or other frameshift PDE3B variant.

In any of the embodiments described herein, the PDE3B predicted loss-of-function polypeptide can be any PDE3B polypeptide having a partial loss-of-function, a complete loss-of-function, a predicted partial loss-of-function, or a predicted complete loss-of-function.

In any of the embodiments described herein, the PDE3B predicted loss-of-function or missense variant nucleic acid molecules encoding variations in the protein sequence can include variations at positions of chromosome 11 using the nucleotide sequence of the PDE3B reference genomic nucleic acid molecule (SEQ ID NO:1; ENSG00000152270.9 chr11:14,643,804-14,872,044 in the GRCh38/hg38 human genome assembly) as a reference sequence.

Numerous genetic variants in PDE3B exist which cause subsequent changes in the PDE3B polypeptide sequence including, but not limited to those listed in Table 1.

TABLE 1

PDE3B Genetic Variants (GRCh38/hg38 human genome assembly)

| Genomic coordinates for the genetic variant, C:P:R:A | Variant classified as pLOF | Transcript |
| --- | --- | --- |
| 11:14644077:T:G | Yes | ENST00000282096:ENST00000455098 |
| 11:14644077:T:C | Yes | ENST00000282096:ENST00000455098 |
| 11:14644078:G:C | Yes | ENST00000282096:ENST00000455098 |
| 11:14644078:G:A | Yes | ENST00000282096:ENST00000455098 |
| 11:14644095:ACG:A | Yes | ENST00000282096:ENST00000455098 |
| 11:14644141:GC:G | Yes | ENST00000282096:ENST00000455098 |
| 11:14644141:G:GC | Yes | ENST00000282096:ENST00000455098 |
| 11:14644153:T:TTA | Yes | ENST00000282096:ENST00000455098 |
| 11:14644196:C:T | Yes | ENST00000282096:ENST00000455098 |
| 11:14644270:T:TC | Yes | ENST00000282096:ENST00000455098 |
| 11:14644324:C:CGCCCT | Yes | ENST00000282096:ENST00000455098 |
| 11:14644378:G:A | Yes | ENST00000282096:ENST00000455098 |
| 11:14644395:G:A | Yes | ENST00000282096:ENST00000455098 |
| 11:14644396:G:A | Yes | ENST00000282096:ENST00000455098 |
| 11:14644415:G:GT | Yes | ENST00000282096:ENST00000455098 |
| 11:14644434:G:GC | Yes | ENST00000282096:ENST00000455098 |
| 11:14644531:G:A | Yes | ENST00000282096:ENST00000455098 |
| 11:14644534:G:A | Yes | ENST00000282096:ENST00000455098 |
| 11:14644560:AC:A | Yes | ENST00000282096:ENST00000455098 |

TABLE 1-continued

PDE3B Genetic Variants (GRCh38/hg38 human genome assembly)

| Genomic coordinates for the genetic variant, C:P:R:A | Variant classified as pLOF | Transcript |
|---|---|---|
| 11:14644582:G:A | Yes | ENST00000282096:ENST00000455098 |
| 11:14644601:T:TG | Yes | ENST00000282096:ENST00000455098 |
| 11:14644602:G:A | Yes | ENST00000282096:ENST00000455098 |
| 11:14644636:CA:C | Yes | ENST00000282096:ENST00000455098 |
| 11:14644795:GC:G | Yes | ENST00000282096:ENST00000455098 |
| 11:14644802:GC:G | Yes | ENST00000282096:ENST00000455098 |
| 11:14644830:T:TG | Yes | ENST00000282096:ENST00000455098 |
| 11:14644904:C:T | Yes | ENST00000282096:ENST00000455098 |
| 11:14644925:GA:G | Yes | ENST00000282096:ENST00000455098 |
| 11:14644930:AG:A | Yes | ENST00000282096:ENST00000455098 |
| 11:14645038:TA:T | Yes | ENST00000282096:ENST00000455098 |
| 11:14645048:G:T | Yes | ENST00000282096:ENST00000455098 |
| 11:14771972:TA:T | Yes | ENST00000282096:ENST00000455098 |
| 11:14771977:C:CTCAA | Yes | ENST00000282096:ENST00000455098 |
| 11:14771984:T:A | Yes | ENST00000282096:ENST00000455098 |
| 11:14771988:GT:G | Yes | ENST00000282096:ENST00000455098 |
| 11:14771988:G:T | Yes | ENST00000282096:ENST00000455098 |
| 11:14786526:AC:A | Yes | ENST00000282096:ENST00000455098 |
| 11:14786554:AT:A | Yes | ENST00000282096 |
| 11:14786634:CT:C | Yes | ENST00000282096 |
| 11:14786686:G:A | Yes | ENST00000282096 |
| 11:14789132:TC:T | Yes | ENST00000282096:ENST00000455098 |
| 11:14789136:C:T | Yes | ENST00000282096:ENST00000455098 |
| 11:14803942:A:T | Yes | ENST00000282096:ENST00000455098 |
| 11:14803943:G:T | Yes | ENST00000282096:ENST00000455098 |
| 11:14803943:G:C | Yes | ENST00000282096:ENST00000455098 |
| 11:14803958:TA:T | Yes | ENST00000282096:ENST00000455098 |
| 11:14803967:CT:C | Yes | ENST00000282096:ENST00000455098 |
| 11:14803982:TA:T | Yes | ENST00000282096:ENST00000455098 |
| 11:14804027:AC:A | Yes | ENST00000282096:ENST00000455098 |
| 11:14804036:GTC:G | Yes | ENST00000282096:ENST00000455098 |
| 11:14818182:G:C | Yes | ENST00000282096:ENST00000455098 |
| 11:14818182:G:A | Yes | ENST00000282096:ENST00000455098 |
| 11:14818244:TCTAA:T | Yes | ENST00000282096:ENST00000455098 |
| 11:14818245:C:CT | Yes | ENST00000282096:ENST00000455098 |
| 11:14818254:C:T | Yes | ENST00000282096:ENST00000455098 |
| 11:14818356:C:T | Yes | ENST00000282096:ENST00000455098 |
| 11:14818394:G:T | Yes | ENST00000282096:ENST00000455098 |
| 11:14819134:A:G | Yes | ENST00000282096:ENST00000455098 |
| 11:14819154:GA:G | Yes | ENST00000282096:ENST00000455098 |
| 11:14819165:C:A | Yes | ENST00000282096:ENST00000455098 |
| 11:14819171:CT:C | Yes | ENST00000282096:ENST00000455098 |
| 11:14830697:G:A | Yes | ENST00000282096:ENST00000455098 |
| 11:14830728:C:A | Yes | ENST00000282096:ENST00000455098 |
| 11:14830764:CAG:C | Yes | ENST00000282096:ENST00000455098 |
| 11:14830773:AAGAC:A | Yes | ENST00000282096:ENST00000455098 |
| 11:14830835:C:T | Yes | ENST00000282096:ENST00000455098 |
| 11:14830838:C:T | Yes | ENST00000282096:ENST00000455098 |
| 11:14831639:G:C | Yes | ENST00000282096:ENST00000455098 |
| 11:14831639:G:T | Yes | ENST00000282096:ENST00000455098 |
| 11:14831649:G:T | Yes | ENST00000282096:ENST00000455098 |
| 11:14831659:TG:T | Yes | ENST00000282096:ENST00000455098 |
| 11:14831679:G:T | Yes | ENST00000282096:ENST00000455098 |
| 11:14831689:C:A | Yes | ENST00000282096:ENST00000455098 |
| 11:14831729:TG:T | Yes | ENST00000282096:ENST00000455098 |
| 11:14831757:TC:T | Yes | ENST00000282096:ENST00000455098 |
| 11:14831769:CTCAG:C | Yes | ENST00000282096:ENST00000455098 |
| 11:14831771:C:CA | Yes | ENST00000282096:ENST00000455098 |
| 11:14832719:TA:T | Yes | ENST00000282096:ENST00000455098 |
| 11:14832742:AG:A | Yes | ENST00000282096:ENST00000455098 |
| 11:14832805:AT:A | Yes | ENST00000282096:ENST00000455098 |
| 11:14832809:GA:G | Yes | ENST00000282096:ENST00000455098 |
| 11:14832818:TATC:T | Yes | ENST00000282096:ENST00000455098 |
| 11:14832821:C:T | Yes | ENST00000282096:ENST00000455098 |
| 11:14832827:A:AT | Yes | ENST00000282096:ENST00000455098 |
| 11:14832831:C:CT | Yes | ENST00000282096:ENST00000455098 |
| 11:14832833:TGTAA:T | Yes | ENST00000282096:ENST00000455098 |
| 11:14832835:T:A | Yes | ENST00000282096:ENST00000455098 |
| 11:14835096:GT:G | Yes | ENST00000282096:ENST00000455098 |
| 11:14835097:T:C | Yes | ENST00000282096:ENST00000455098 |
| 11:14843825:A:G | Yes | ENST00000282096:ENST00000455098 |
| 11:14843853:C:T | Yes | ENST00000282096:ENST00000455098 |
| 11:14843922:AT:A | Yes | ENST00000282096:ENST00000455098 |
| 11:14843951:C:A | Yes | ENST00000282096:ENST00000455098 |

TABLE 1-continued

PDE3B Genetic Variants (GRCh38/hg38 human genome assembly)

| Genomic coordinates for the genetic variant, C:P:R:A | Variant classified as pLOF | Transcript |
| --- | --- | --- |
| 11:14843951:C:G | Yes | ENST00000282096:ENST00000455098 |
| 11:14844028:T:G | Yes | ENST00000282096:ENST00000455098 |
| 11:14859111:T:TTC | Yes | ENST00000282096:ENST00000455098 |
| 11:14859176:T:G | Yes | ENST00000282096:ENST00000455098 |
| 11:14859247:GT:G | Yes | ENST00000282096:ENST00000455098 |
| 11:14861232:G:T | Yes | ENST00000282096:ENST00000455098 |
| 11:14861313:C:T | Yes | ENST00000282096:ENST00000455098 |
| 11:14861332:G:A | Yes | ENST00000282096:ENST00000455098 |
| 11:14861367:G:GT | Yes | ENST00000282096:ENST00000455098 |
| 11:14861367:G:T | Yes | ENST00000282096:ENST00000455098 |
| 11:14861368:T:C | Yes | ENST00000282096:ENST00000455098 |
| 11:14867549:T:TG | Yes | ENST00000282096:ENST00000455098 |
| 11:14867573:CA:C | Yes | ENST00000282096:ENST00000455098 |
| 11:14867619:T:A | Yes | ENST00000282096:ENST00000455098 |
| 11:14867658:G:A | Yes | ENST00000282096:ENST00000455098 |
| 11:14867719:GA:G | Yes | ENST00000282096:ENST00000455098 |
| 11:14867756:CAAGT:C | Yes | ENST00000282096:ENST00000455098 |
| 11:14867759:G:T | Yes | ENST00000282096:ENST00000455098 |
| 11:14869487:C:T | Yes | ENST00000282096:ENST00000455098 |
| 11:14869589:C:T | Yes | ENST00000282096:ENST00000455098 |
| 11:14869644:C:CAGAT | Yes | ENST00000282096:ENST00000455098 |
| 11:14869658:T:C | Yes | ENST00000282096:ENST00000455098 |
| 11:14644077:T:G | Yes | ENST00000282096:ENST00000455098 |
| 11:14644077:T:C | Yes | ENST00000282096:ENST00000455098 |
| 11:14644078:G:A | Yes | ENST00000282096:ENST00000455098 |
| 11:14644078:G:C | Yes | ENST00000282096:ENST00000455098 |
| 11:14644095:ACG:A | Yes | ENST00000282096:ENST00000455098 |
| 11:14644141:GC:G | Yes | ENST00000282096:ENST00000455098 |
| 11:14644141:G:GC | Yes | ENST00000282096:ENST00000455098 |
| 11:14644153:T:TTA | Yes | ENST00000282096:ENST00000455098 |
| 11:14644196:C:T | Yes | ENST00000282096:ENST00000455098 |
| 11:14644270:T:TC | Yes | ENST00000282096:ENST00000455098 |
| 11:14644324:C:CGCCCT | Yes | ENST00000282096:ENST00000455098 |
| 11:14644378:G:A | Yes | ENST00000282096:ENST00000455098 |
| 11:14644395:G:A | Yes | ENST00000282096:ENST00000455098 |
| 11:14644396:G:A | Yes | ENST00000282096:ENST00000455098 |
| 11:14644415:G:GT | Yes | ENST00000282096:ENST00000455098 |
| 11:14644434:G:GC | Yes | ENST00000282096:ENST00000455098 |
| 11:14644531:G:A | Yes | ENST00000282096:ENST00000455098 |
| 11:14644534:G:A | Yes | ENST00000282096:ENST00000455098 |
| 11:14644560:AC:A | Yes | ENST00000282096:ENST00000455098 |
| 11:14644582:G:A | Yes | ENST00000282096:ENST00000455098 |
| 11:14644601:T:TG | Yes | ENST00000282096:ENST00000455098 |
| 11:14644602:G:A | Yes | ENST00000282096:ENST00000455098 |
| 11:14644636:CA:C | Yes | ENST00000282096:ENST00000455098 |
| 11:14644795:GC:G | Yes | ENST00000282096:ENST00000455098 |
| 11:14644802:GC:G | Yes | ENST00000282096:ENST00000455098 |
| 11:14644830:T:TG | Yes | ENST00000282096:ENST00000455098 |
| 11:14644904:C:T | Yes | ENST00000282096:ENST00000455098 |
| 11:14644925:GA:G | Yes | ENST00000282096:ENST00000455098 |
| 11:14644930:AG:A | Yes | ENST00000282096:ENST00000455098 |
| 11:14645038:TA:T | Yes | ENST00000282096:ENST00000455098 |
| 11:14645048:G:T | Yes | ENST00000282096:ENST00000455098 |
| 11:14771972:TA:T | Yes | ENST00000282096:ENST00000455098 |
| 11:14771977:C:CTCAA | Yes | ENST00000282096:ENST00000455098 |
| 11:14771984:T:A | Yes | ENST00000282096:ENST00000455098 |
| 11:14771988:GT:G | Yes | ENST00000282096:ENST00000455098 |
| 11:14771988:G:T | Yes | ENST00000282096:ENST00000455098 |
| 11:14786526:AC:A | Yes | ENST00000282096:ENST00000455098 |
| 11:14786554:AT:A | Yes | ENST00000282096 |
| 11:14786634:CT:C | Yes | ENST00000282096 |
| 11:14786686:G:A | Yes | ENST00000282096 |
| 11:14789132:TC:T | Yes | ENST00000282096:ENST00000455098 |
| 11:14789136:C:T | Yes | ENST00000282096:ENST00000455098 |
| 11:14803942:A:T | Yes | ENST00000282096:ENST00000455098 |
| 11:14803943:G:T | Yes | ENST00000282096:ENST00000455098 |
| 11:14803943:G:C | Yes | ENST00000282096:ENST00000455098 |
| 11:14803958:TA:T | Yes | ENST00000282096:ENST00000455098 |
| 11:14803967:CT:C | Yes | ENST00000282096:ENST00000455098 |
| 11:14803982:TA:T | Yes | ENST00000282096:ENST00000455098 |
| 11:14804027:AC:A | Yes | ENST00000282096:ENST00000455098 |
| 11:14804036:GTC:G | Yes | ENST00000282096:ENST00000455098 |
| 11:14818182:G:A | Yes | ENST00000282096:ENST00000455098 |
| 11:14818182:G:C | Yes | ENST00000282096:ENST00000455098 |

TABLE 1-continued

| PDE3B Genetic Variants (GRCh38/hg38 human genome assembly) | | |
|---|---|---|
| Genomic coordinates for the genetic variant, C:P:R:A | Variant classified as pLOF | Transcript |
| 11:14818244:TCTAA:T | Yes | ENST00000282096:ENST00000455098 |
| 11:14818245:C:CT | Yes | ENST00000282096:ENST00000455098 |
| 11:14818254:C:T | Yes | ENST00000282096:ENST00000455098 |
| 11:14818356:C:T | Yes | ENST00000282096:ENST00000455098 |
| 11:14818394:G:T | Yes | ENST00000282096:ENST00000455098 |
| 11:14819134:A:G | Yes | ENST00000282096:ENST00000455098 |
| 11:14819154:GA:G | Yes | ENST00000282096:ENST00000455098 |
| 11:14819165:C:A | Yes | ENST00000282096:ENST00000455098 |
| 11:14819171:CT:C | Yes | ENST00000282096:ENST00000455098 |
| 11:14830697:G:A | Yes | ENST00000282096:ENST00000455098 |
| 11:14830728:C:A | Yes | ENST00000282096:ENST00000455098 |
| 11:14830764:CAG:C | Yes | ENST00000282096:ENST00000455098 |
| 11:14830773:AAGAC:A | Yes | ENST00000282096:ENST00000455098 |
| 11:14830835:C:T | Yes | ENST00000282096:ENST00000455098 |
| 11:14830838:C:T | Yes | ENST00000282096:ENST00000455098 |
| 11:14831639:G:T | Yes | ENST00000282096:ENST00000455098 |
| 11:14831639:G:C | Yes | ENST00000282096:ENST00000455098 |
| 11:14831649:G:T | Yes | ENST00000282096:ENST00000455098 |
| 11:14831659:TG:T | Yes | ENST00000282096:ENST00000455098 |
| 11:14831679:G:T | Yes | ENST00000282096:ENST00000455098 |
| 11:14831689:C:A | Yes | ENST00000282096:ENST00000455098 |
| 11:14831709:A:C | No | ENST00000282096:ENST00000455098 |
| 11:14831725:T:C | No | ENST00000282096:ENST00000455098 |
| 11:14831729:TG:T | Yes | ENST00000282096:ENST00000455098 |
| 11:14831757:TC:T | Yes | ENST00000282096:ENST00000455098 |
| 11:14831764:G:T | No | ENST00000282096:ENST00000455098 |
| 11:14831769:CTCAG:C | Yes | ENST00000282096:ENST00000455098 |
| 11:14831771:C:CA | Yes | ENST00000282096:ENST00000455098 |
| 11:14832719:TA:T | Yes | ENST00000282096:ENST00000455098 |
| 11:14832723:T:C | No | ENST00000282096:ENST00000455098 |
| 11:14832729:A:G | No | ENST00000282096:ENST00000455098 |
| 11:14832738:T:G | No | ENST00000282096:ENST00000455098 |
| 11:14832742:A:T | No | ENST00000282096:ENST00000455098 |
| 11:14832742:AG:A | Yes | ENST00000282096:ENST00000455098 |
| 11:14832743:G:C | No | ENST00000282096:ENST00000455098 |
| 11:14832743:G:A | No | ENST00000282096:ENST00000455098 |
| 11:14832749:G:A | No | ENST00000282096:ENST00000455098 |
| 11:14832774:C:A | No | ENST00000282096:ENST00000455098 |
| 11:14832798:T:G | No | ENST00000282096:ENST00000455098 |
| 11:14832804:C:A | No | ENST00000282096:ENST00000455098 |
| 11:14832805:AT:A | Yes | ENST00000282096:ENST00000455098 |
| 11:14832809:GA:G | Yes | ENST00000282096:ENST00000455098 |
| 11:14832818:TATC:T | Yes | ENST00000282096:ENST00000455098 |
| 11:14832821:C:T | Yes | ENST00000282096:ENST00000455098 |
| 11:14832827:A:AT | Yes | ENST00000282096:ENST00000455098 |
| 11:14832830:C:A | No | ENST00000282096:ENST00000455098 |
| 11:14832831:C:CT | Yes | ENST00000282096:ENST00000455098 |
| 11:14832831:C:A | No | ENST00000282096:ENST00000455098 |
| 11:14832833:TGTAA:T | Yes | ENST00000282096:ENST00000455098 |
| 11:14832835:T:A | Yes | ENST00000282096:ENST00000455098 |
| 11:14834982:A:T | No | ENST00000282096:ENST00000455098 |
| 11:14834984:C:A | No | ENST00000282096:ENST00000455098 |
| 11:14834988:A:G | No | ENST00000282096:ENST00000455098 |
| 11:14834990:C:T | No | ENST00000282096:ENST00000455098 |
| 11:14834991:G:A | No | ENST00000282096:ENST00000455098 |
| 11:14834996:C:T | No | ENST00000282096:ENST00000455098 |
| 11:14835011:C:A | No | ENST00000282096:ENST00000455098 |
| 11:14835014:C:T | No | ENST00000282096:ENST00000455098 |
| 11:14835020:G:A | No | ENST00000282096:ENST00000455098 |
| 11:14835038:C:T | No | ENST00000282096:ENST00000455098 |
| 11:14835096:GT:G | Yes | ENST00000282096:ENST00000455098 |
| 11:14835097:T:C | Yes | ENST00000282096:ENST00000455098 |
| 11:14843825:A:G | Yes | ENST00000282096:ENST00000455098 |
| 11:14843853:C:T | Yes | ENST00000282096:ENST00000455098 |
| 11:14843863:A:G | No | ENST00000282096:ENST00000455098 |
| 11:14843872:C:T | No | ENST00000282096:ENST00000455098 |
| 11:14843901:T:C | No | ENST00000282096:ENST00000455098 |
| 11:14843911:T:C | No | ENST00000282096:ENST00000455098 |
| 11:14843914:C:T | No | ENST00000282096:ENST00000455098 |
| 11:14843920:A:T | No | ENST00000282096:ENST00000455098 |
| 11:14843922:AT:A | Yes | ENST00000282096:ENST00000455098 |
| 11:14843923:T:C | No | ENST00000282096:ENST00000455098 |
| 11:14843923:T:A | No | ENST00000282096:ENST00000455098 |
| 11:14843941:T:A | No | ENST00000282096:ENST00000455098 |

TABLE 1-continued

PDE3B Genetic Variants (GRCh38/hg38 human genome assembly)

| Genomic coordinates for the genetic variant, C:P:R:A | Variant classified as pLOF | Transcript |
|---|---|---|
| 11:14843942:G:A | No | ENST00000282096:ENST00000455098 |
| 11:14843946:C:G | No | ENST00000282096:ENST00000455098 |
| 11:14843951:C:G | Yes | ENST00000282096:ENST00000455098 |
| 11:14843951:C:A | Yes | ENST00000282096:ENST00000455098 |
| 11:14843952:G:A | No | ENST00000282096:ENST00000455098 |
| 11:14843958:G:C | No | ENST00000282096:ENST00000455098 |
| 11:14843968:A:G | No | ENST00000282096:ENST00000455098 |
| 11:14843968:A:C | No | ENST00000282096:ENST00000455098 |
| 11:14843979:C:T | No | ENST00000282096:ENST00000455098 |
| 11:14843985:G:A | No | ENST00000282096:ENST00000455098 |
| 11:14843988:A:G | No | ENST00000282096:ENST00000455098 |
| 11:14843989:G:A | No | ENST00000282096:ENST00000455098 |
| 11:14843992:C:A | No | ENST00000282096:ENST00000455098 |
| 11:14843992:C:T | No | ENST00000282096:ENST00000455098 |
| 11:14843997:G:T | No | ENST00000282096:ENST00000455098 |
| 11:14844006:G:T | No | ENST00000282096:ENST00000455098 |
| 11:14844010:C:T | No | ENST00000282096:ENST00000455098 |
| 11:14844026:G:C | No | ENST00000282096:ENST00000455098 |
| 11:14844028:T:G | Yes | ENST00000282096:ENST00000455098 |
| 11:14859043:G:T | No | ENST00000282096:ENST00000455098 |
| 11:14859053:A:G | No | ENST00000282096:ENST00000455098 |
| 11:14859056:A:G | No | ENST00000282096:ENST00000455098 |
| 11:14859057:T:G | No | ENST00000282096:ENST00000455098 |
| 11:14859062:G:T | No | ENST00000282096:ENST00000455098 |
| 11:14859063:A:T | No | ENST00000282096:ENST00000455098 |
| 11:14859065:C:T | No | ENST00000282096:ENST00000455098 |
| 11:14859074:A:G | No | ENST00000282096:ENST00000455098 |
| 11:14859077:A:G | No | ENST00000282096:ENST00000455098 |
| 11:14859079:C:T | No | ENST00000282096:ENST00000455098 |
| 11:14859080:A:G | No | ENST00000282096:ENST00000455098 |
| 11:14859081:T:A | No | ENST00000282096:ENST00000455098 |
| 11:14859089:C:T | No | ENST00000282096:ENST00000455098 |
| 11:14859099:G:T | No | ENST00000282096:ENST00000455098 |
| 11:14859106:T:C | No | ENST00000282096:ENST00000455098 |
| 11:14859109:C:T | No | ENST00000282096:ENST00000455098 |
| 11:14859109:C:G | No | ENST00000282096:ENST00000455098 |
| 11:14859109:C:A | No | ENST00000282096:ENST00000455098 |
| 11:14859111:T:TTC | Yes | ENST00000282096:ENST00000455098 |
| 11:14859162:G:C | No | ENST00000282096:ENST00000455098 |
| 11:14859163:C:T | No | ENST00000282096:ENST00000455098 |
| 11:14859164:G:T | No | ENST00000282096:ENST00000455098 |
| 11:14859170:G:T | No | ENST00000282096:ENST00000455098 |
| 11:14859170:G:A | No | ENST00000282096:ENST00000455098 |
| 11:14859176:T:G | Yes | ENST00000282096:ENST00000455098 |
| 11:14859176:T:C | No | ENST00000282096:ENST00000455098 |
| 11:14859183:T:G | No | ENST00000282096:ENST00000455098 |
| 11:14859185:A:G | No | ENST00000282096:ENST00000455098 |
| 11:14859200:C:T | No | ENST00000282096:ENST00000455098 |
| 11:14859213:G:C | No | ENST00000282096:ENST00000455098 |
| 11:14859216:T:G | No | ENST00000282096:ENST00000455098 |
| 11:14859220:G:T | No | ENST00000282096:ENST00000455098 |
| 11:14859229:G:A | No | ENST00000282096:ENST00000455098 |
| 11:14859239:A:G | No | ENST00000282096:ENST00000455098 |
| 11:14859247:GT:G | Yes | ENST00000282096:ENST00000455098 |
| 11:14861232:G:T | Yes | ENST00000282096:ENST00000455098 |
| 11:14861254:G:A | No | ENST00000282096:ENST00000455098 |
| 11:14861262:G:A | No | ENST00000282096:ENST00000455098 |
| 11:14861275:G:T | No | ENST00000282096:ENST00000455098 |
| 11:14861277:A:T | No | ENST00000282096:ENST00000455098 |
| 11:14861278:T:C | No | ENST00000282096:ENST00000455098 |
| 11:14861287:C:A | No | ENST00000282096:ENST00000455098 |
| 11:14861293:T:C | No | ENST00000282096:ENST00000455098 |
| 11:14861297:T:G | No | ENST00000282096:ENST00000455098 |
| 11:14861299:G:A | No | ENST00000282096:ENST00000455098 |
| 11:14861301:C:T | No | ENST00000282096:ENST00000455098 |
| 11:14861305:C:A | No | ENST00000282096:ENST00000455098 |
| 11:14861307:A:G | No | ENST00000282096:ENST00000455098 |
| 11:14861313:C:G | No | ENST00000282096:ENST00000455098 |
| 11:14861313:C:T | Yes | ENST00000282096:ENST00000455098 |
| 11:14861332:G:A | Yes | ENST00000282096:ENST00000455098 |
| 11:14861335:C:A | No | ENST00000282096:ENST00000455098 |
| 11:14861338:A:G | No | ENST00000282096:ENST00000455098 |
| 11:14861341:G:A | No | ENST00000282096:ENST00000455098 |
| 11:14861344:T:C | No | ENST00000282096:ENST00000455098 |

TABLE 1-continued

PDE3B Genetic Variants (GRCh38/hg38 human genome assembly)

| Genomic coordinates for the genetic variant, C:P:R:A | Variant classified as pLOF | Transcript |
| --- | --- | --- |
| 11:14861359:A:G | No | ENST00000282096:ENST00000455098 |
| 11:14861365:A:G | No | ENST00000282096:ENST00000455098 |
| 11:14861367:G:T | Yes | ENST00000282096:ENST00000455098 |
| 11:14861367:G:GT | Yes | ENST00000282096:ENST00000455098 |
| 11:14861368:T:C | Yes | ENST00000282096:ENST00000455098 |
| 11:14867507:G:C | No | ENST00000282096:ENST00000455098 |
| 11:14867516:A:C | No | ENST00000282096:ENST00000455098 |
| 11:14867527:G:A | No | ENST00000282096:ENST00000455098 |
| 11:14867534:C:T | No | ENST00000282096:ENST00000455098 |
| 11:14867542:C:G | No | ENST00000282096:ENST00000455098 |
| 11:14867543:C:T | No | ENST00000282096:ENST00000455098 |
| 11:14867548:A:G | No | ENST00000282096:ENST00000455098 |
| 11:14867549:T:TG | Yes | ENST00000282096:ENST00000455098 |
| 11:14867554:C:T | No | ENST00000282096:ENST00000455098 |
| 11:14867555:G:A | No | ENST00000282096:ENST00000455098 |
| 11:14867558:C:G | No | ENST00000282096:ENST00000455098 |
| 11:14867572:G:C | No | ENST00000282096:ENST00000455098 |
| 11:14867573:CA:C | Yes | ENST00000282096:ENST00000455098 |
| 11:14867587:T:A | No | ENST00000282096:ENST00000455098 |
| 11:14867588:C:A | No | ENST00000282096:ENST00000455098 |
| 11:14867593:A:G | No | ENST00000282096:ENST00000455098 |
| 11:14867595:C:G | No | ENST00000282096:ENST00000455098 |
| 11:14867601:C:G | No | ENST00000282096:ENST00000455098 |
| 11:14867605:G:A | No | ENST00000282096:ENST00000455098 |
| 11:14867617:T:C | No | ENST00000282096:ENST00000455098 |
| 11:14867619:T:A | Yes | ENST00000282096:ENST00000455098 |
| 11:14867627:A:T | No | ENST00000282096:ENST00000455098 |
| 11:14867627:A:G | No | ENST00000282096:ENST00000455098 |
| 11:14867658:G:A | Yes | ENST00000282096:ENST00000455098 |
| 11:14867719:GA:G | Yes | ENST00000282096:ENST00000455098 |
| 11:14867756:CAAGT:C | Yes | ENST00000282096:ENST00000455098 |
| 11:14867759:G:T | Yes | ENST00000282096:ENST00000455098 |
| 11:14869484:C:T | No | ENST00000282096:ENST00000455098 |
| 11:14869487:C:T | Yes | ENST00000282096:ENST00000455098 |
| 11:14869535:T:C | No | ENST00000282096:ENST00000455098 |
| 11:14869589:C:T | Yes | ENST00000282096:ENST00000455098 |
| 11:14869644:C:CAGAT | Yes | ENST00000282096:ENST00000455098 |
| 11:14869658:T:C | Yes | ENST00000282096:ENST00000455098 |
| 11:14644687:AG:A | Yes | ENST00000282096:ENST00000455098 |
| 11:14771943:CT:C | Yes | ENST00000282096:ENST00000455098 |
| 11:14771952:TG:T | Yes | ENST00000282096:ENST00000455098 |
| 11:14771980:AT:A | Yes | ENST00000282096:ENST00000455098 |
| 11:14771982:TA:T | Yes | ENST00000282096:ENST00000455098 |
| 11:14789135:AC:A | Yes | ENST00000282096:ENST00000455098 |
| 11:14789145:A:T | Yes | ENST00000282096:ENST00000455098 |
| 11:14789223:C:T | Yes | ENST00000282096:ENST00000455098 |
| 11:14803942:A:G | Yes | ENST00000282096:ENST00000455098 |
| 11:14803971:T:TTA | Yes | ENST00000282096:ENST00000455098 |
| 11:14819139:TG:T | Yes | ENST00000282096:ENST00000455098 |
| 11:14830837:GCAAA:G | Yes | ENST00000282096:ENST00000455098 |
| 11:14834990:CG:C | Yes | ENST00000282096:ENST00000455098 |
| 11:14843888:TC:T | Yes | ENST00000282096:ENST00000455098 |
| 11:14859054:C:A | Yes | ENST00000282096:ENST00000455098 |
| 11:14867653:C:T | Yes | ENST00000282096:ENST00000455098 |

Any one or more (i.e., any combination) of the PDE3B predicted loss-of-function or missense variant nucleic acid molecules can be used within any of the methods described herein to determine whether a subject has an increased risk of developing a liver disease or type 2 diabetes. The combinations of particular variants can form a mask or burden genotype used for statistical analysis of the particular correlation of PDE3B and risk of developing a liver disease or type 2 diabetes.

In any of the embodiments described herein, the liver disease is parenchymal liver disease, liver injury, hepatocellular carcinoma, liver cirrhosis, liver fibrosis, simple steatosis, steatohepatitis, or non-alcoholic steatohepatitis (NASH), liver inflammation, and/or fatty liver disease (such as alcoholic fatty liver disease (AFLD) or nonalcoholic fatty liver disease (NAFLD)). In some embodiments, the liver disease is parenchymal liver disease. In some embodiments, the liver disease is liver injury. In some embodiments, the liver disease is hepatocellular carcinoma. In some embodiments, the liver disease is liver cirrhosis. In some embodiments, the liver disease is liver fibrosis. In some embodiments, the liver disease is simple steatosis. In some embodiments, the liver disease is steatohepatitis. In some embodiments, the liver disease is NASH. In some embodiments, the liver disease is liver inflammation. In some embodiments, the liver disease is a fatty liver disease. In some embodiments, the liver disease is AFLD. In some embodiments, the liver disease is NAFLD.

Symptoms of liver disease include, but are not limited to, enlarged liver, fatigue, pain in the upper right abdomen, abdominal swelling (ascites), enlarged blood vessels just beneath the skin's surface, enlarged breasts in men, enlarged spleen, red palms, and yellowing of the skin and eyes (jaundice), pruritus, dark urine color, pale stool color nausea or vomiting, loss of appetite, and tendency to bruise easily. Testing for liver diseases can involve blood tests, imaging of the liver, and biopsy of the liver. An individual is at increased risk of a liver disease if the subject has at least one known risk-factor (e.g., genetic factor such as a disease-causing mutation) placing individuals with that risk factor at a statistically significant greater risk of developing the disease than individuals without the risk factor. Risk factors for liver diseases are also well known and can include, for example, excessive alcohol use, obesity, high cholesterol, high levels of triglycerides in the blood, polycystic ovary syndrome, sleep apnea, type 2 diabetes, underactive thyroid (hypothyroidism), underactive pituitary gland (hypopituitarism), and metabolic syndromes including raised blood lipids.

Symptoms of diabetes disease include, but are not limited to, increased urination, persistent thirst, weight loss, persistent hunger, blurry vision, numbness in hands and feet, chronic fatigue, dry skin, slow healing sores, increased susceptibility to infections, nausea, vomiting, or stomach pains. A subject is at increased risk of developing a diabetes if the subject has at least one known risk-factor placing individuals with that risk factor at a statistically significant greater risk of developing the disease than individuals without the risk factor. Risk factors for diabetes include, for example, family history, age, presence of prediabetes, excessive body weight, and sedentary lifestyle.

The present disclosure provides methods of treating a subject having a liver disease, or having a risk for developing a liver disease, or who have risk factors for developing a liver disease, or who have a risk of developing complications of a liver disease, the methods comprising administering a PDE3B inhibitor to the subject.

The present disclosure also provides methods of treating a subject having a fatty liver disease, or having a risk for developing a fatty liver disease, or who have risk factors for developing a fatty liver disease, or who have a risk of developing complications of a fatty liver disease, the methods comprising administering a PDE3B inhibitor to the subject.

The present disclosure also provides methods of treating a subject having hepatocellular carcinoma, or having a risk for developing hepatocellular carcinoma, or who have risk factors for developing hepatocellular carcinoma, or who have a risk of developing complications of hepatocellular carcinoma, the methods comprising administering a PDE3B inhibitor to the subject.

The present disclosure also provides methods of treating a subject having liver cirrhosis, or having a risk for developing liver cirrhosis, or who have risk factors for developing liver cirrhosis, or who have a risk of developing complications of liver cirrhosis, the methods comprising administering a PDE3B to the subject.

The present disclosure also provides methods of treating a subject having liver fibrosis, or having a risk for developing liver fibrosis, or who have risk factors for developing liver fibrosis, or who have a risk of developing complications of liver fibrosis, the methods comprising administering a PDE3B inhibitor to the subject.

The present disclosure also provides methods of treating a subject having simple steatosis, steatohepatitis, or NASH, or having a risk for developing simple steatosis, steatohepatitis, or NASH, or who have risk factors for developing simple steatosis, steatohepatitis, or NASH, or who have a risk of developing complications of simple steatosis, steatohepatitis, or NASH, the methods comprising administering a PDE3B inhibitor to the subject.

The present disclosure also provides methods of treating a subject having a liver injury, or having a risk for developing a liver injury, or who have risk factors for developing a liver injury, or who have a risk of developing complications of a liver injury, the methods comprising administering a PDE3B inhibitor to the subject.

The present disclosure also provides methods of treating a subject having type 2 diabetes, or having a risk for developing type 2 diabetes, or who have risk factors for developing type 2 diabetes, or who have a risk of developing complications of type 2 diabetes, the methods comprising administering a PDE3B inhibitor to the subject.

The embodiments described herein can be applied to any subject that has any of the indications described herein, or has a risk for developing any of the indications described herein, or who has risk factors for developing any of the indications described herein, or who has a risk of developing complications of any of the indications described herein.

In some embodiments, the PDE3B inhibitor comprises an inhibitory nucleic acid molecule. Examples of inhibitory nucleic acid molecules include, but are not limited to, antisense nucleic acid molecules, small interfering RNAs (siRNAs), and short hairpin RNAs (shRNAs). Such inhibitory nucleic acid molecules can be designed to target any region of a PDE3B mRNA. In some embodiments, the antisense RNA, siRNA, or shRNA hybridizes to a sequence within a PDE3B genomic nucleic acid molecule or mRNA molecule and decreases expression of the PDE3B polypeptide in a cell in the subject. In some embodiments, the PDE3B inhibitor comprises an antisense RNA that hybridizes to a PDE3B genomic nucleic acid molecule or mRNA molecule and decreases expression of the PDE3B polypeptide in a cell in the subject. In some embodiments, the PDE3B inhibitor comprises an siRNA that hybridizes to a PDE3B genomic nucleic acid molecule or mRNA molecule and decreases expression of the PDE3B polypeptide in a cell in the subject. In some embodiments, the PDE3B inhibitor comprises an shRNA that hybridizes to a PDE3B genomic nucleic acid molecule or mRNA molecule and decreases expression of the PDE3B polypeptide in a cell in the subject.

In some embodiments, the antisense nucleic acid molecules comprise or consist of any of the nucleotide sequences represented by SEQ ID NOs: 35-864. In some embodiments, the siRNA molecules comprise or consist of any of the nucleotide sequences (sense and antisense strands) represented by SEQ ID NOs: 865-3210 (e.g., the sense strand is, for example, SEQ ID NO:865 and the corresponding antisense strand is SEQ ID NO:866; the sense strand is, for example, SEQ ID NO:867 and the corresponding antisense strand is SEQ ID NO:868; the sense strand is, for example, SEQ ID NO:3209 and the corresponding antisense strand is SEQ ID NO:3210; etc.).

The inhibitory nucleic acid molecules disclosed herein can comprise RNA, DNA, or both RNA and DNA. The inhibitory nucleic acid molecules can also be linked or fused to a heterologous nucleic acid sequence, such as in a vector, or a heterologous label. For example, the inhibitory nucleic acid molecules disclosed herein can be within a vector or as an exogenous donor sequence comprising the inhibitory nucleic acid molecule and a heterologous nucleic acid sequence. The inhibitory nucleic acid molecules can also be linked or fused to a heterologous label. The label can be directly detectable (such as, for example, fluorophore) or indirectly detectable (such as, for example, hapten, enzyme, or fluorophore quencher). Such labels can be detectable by spectroscopic, photochemical, biochemical, immunochemical, or chemical means. Such labels include, for example, radiolabels, pigments, dyes, chromogens, spin labels, and fluorescent labels. The label can also be, for example, a chemiluminescent substance; a metal-containing substance; or an enzyme, where there occurs an enzyme-dependent secondary generation of signal. The term "label" can also refer to a "tag" or hapten that can bind selectively to a conjugated molecule such that the conjugated molecule, when added subsequently along with a substrate, is used to generate a detectable signal. For example, biotin can be used as a tag along with an avidin or streptavidin conjugate of horseradish peroxidate (HRP) to bind to the tag, and examined using a calorimetric substrate (such as, for example, tetramethylbenzidine (TMB)) or a fluorogenic substrate to detect the presence of HRP. Exemplary labels that can be used as tags to facilitate purification include, but are not limited to, myc, HA, FLAG or 3XFLAG, 6XHis or polyhistidine, glutathione-S-transferase (GST), maltose binding protein, an epitope tag, or the Fc portion of immunoglobulin. Numerous labels include, for example, particles, fluorophores, haptens, enzymes and their calorimetric, fluorogenic and chemiluminescent substrates and other labels.

The disclosed inhibitory nucleic acid molecules can comprise, for example, nucleotides or non-natural or modified nucleotides, such as nucleotide analogs or nucleotide substitutes. Such nucleotides include a nucleotide that contains a modified base, sugar, or phosphate group, or that incorporates a non-natural moiety in its structure. Examples of non-natural nucleotides include, but are not limited to, dideoxynucleotides, biotinylated, aminated, deaminated, alkylated, benzylated, and fluorophor-labeled nucleotides.

The inhibitory nucleic acid molecules disclosed herein can also comprise one or more nucleotide analogs or substitutions. A nucleotide analog is a nucleotide which contains a modification to either the base, sugar, or phosphate moieties. Modifications to the base moiety include, but are not limited to, natural and synthetic modifications of A, C, G, and T/U, as well as different purine or pyrimidine bases such as, for example, pseudouridine, uracil-5-yl, hypoxanthin-9-yl (I), and 2-aminoadenin-9-yl. Modified bases include, but are not limited to, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo (such as, for example, 5-bromo), 5-trifluoromethyl and other 5-substituted uracils and cytosines, 7-methylguanine, 7-methyladenine, 8-azaguanine, 8-azaadenine, 7-deazaguanine, 7-deazaadenine, 3-deazaguanine, and 3-deazaadenine.

Nucleotide analogs can also include modifications of the sugar moiety. Modifications to the sugar moiety include, but are not limited to, natural modifications of the ribose and deoxy ribose as well as synthetic modifications. Sugar modifications include, but are not limited to, the following modifications at the 2' position: OH; F; O-, S-, or N-alkyl; O-, S-, or N-alkenyl; O-, S- or N-alkynyl; or O-alkyl-O-alkyl, wherein the alkyl, alkenyl, and alkynyl may be substituted or unsubstituted $C_{1-10}$alkyl or $C_{2-10}$alkenyl, and $C_{2-10}$alkynyl. Exemplary 2' sugar modifications also include, but are not limited to, —O[(CH$_2$)$_n$O]$_m$CH$_3$, —O(CH$_2$)$_n$OCH$_3$, —O(CH$_2$)$_n$NH$_2$, —O(CH$_2$)$_n$CH$_3$, —O(CH$_2$)$_n$—ON H$_2$, and —O(CH$_2$)$_n$ON[(CH$_2$)$_n$CH$_3$)]$_2$, where n and m, independently, are from 1 to about 10. Other modifications at the 2' position include, but are not limited to, $C_{1-10}$alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N3, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as CH$_2$ and S. Nucleotide sugar analogs can also have sugar mimetics, such as cyclobutyl moieties in place of the pentofuranosyl sugar.

Nucleotide analogs can also be modified at the phosphate moiety. Modified phosphate moieties include, but are not limited to, those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts, and free acid forms are also included. Nucleotide substitutes also include peptide nucleic acids (PNAs).

In some embodiments, the antisense nucleic acid molecules are gapmers, whereby the first one to seven nucleotides at the 5' and 3' ends each have 2'-methoxyethyl (2'-MOE) modifications. In some embodiments, the first five nucleotides at the 5' and 3' ends each have 2'-MOE modifications. In some embodiments, the first one to seven nucleotides at the 5' and 3' ends are RNA nucleotides. In some embodiments, the first five nucleotides at the 5' and 3' ends are RNA nucleotides. In some embodiments, each of the backbone linkages between the nucleotides is a phosphorothioate linkage.

In some embodiments, the siRNA molecules have termini modifications. In some embodiments, the 5' end of the antisense strand is phosphorylated. In some embodiments, 5'-phosphate analogs that cannot be hydrolyzed, such as 5'-(E)-vinyl-phosphonate are used.

In some embodiments, the siRNA molecules have backbone modifications. In some embodiments, the modified phosphodiester groups that link consecutive ribose nucleosides have been shown to enhance the stability and in vivo bioavailability of siRNAs The non-ester groups (—OH, =O) of the phosphodiester linkage can be replaced with sulfur, boron, or acetate to give phosphorothioate, boranophosphate, and phosphonoacetate linkages. In addition, substituting the phosphodiester group with a phosphotriester can facilitate cellular uptake of siRNAs and retention on serum components by eliminating their negative charge. In some embodiments, the siRNA molecules have sugar modifications. In some embodiments, the sugars are deprotonated (reaction catalyzed by exo- and endonucleases) whereby the 2'-hydroxyl can act as a nucleophile and attack the adjacent phosphorous in the phosphodiester bond. Such alternatives include 2'-O-methyl, 2'-O-methoxyethyl, and 2'-fluoro modifications.

In some embodiments, the siRNA molecules have base modifications. In some embodiments, the bases can be substituted with modified bases such as pseudouridine, 5'-methylcytidine, N6-methyladenosine, inosine, and N7-methylguanosine.

In some embodiments, the siRNA molecules are conjugated to lipids. Lipids can be conjugated to the 5' or 3' termini of siRNA to improve their in vivo bioavailability by allowing them to associate with serum lipoproteins. Representative lipids include, but are not limited to, cholesterol and vitamin E, and fatty acids, such as palmitate and tocopherol.

In some embodiments, a representative siRNA has the following formula:
Sense: mN*mN*/i2FN/mN/i2FN/mN/i2FN/mN/i2FN/mN/ i2FN/mN/i2FN/mN/i2FN/mN/i2FN/*mN*/32FN/
Antisense: /52FN/*/i2FN/*mN/i2FN/mN/i2FN/mN/i2FN/ mN/i2FN/mN/i2FN/mN/i2FN/mN/i2FN/mN/i2FN/ mN*N*N wherein: "N" is the base; "2F" is a 2'-F modification; "m" is a 2'-O-methyl modification, "I" is an internal base; and "*" is a phosphorothioate backbone linkage. The present disclosure also provides vectors comprising any one or more of the inhibitory nucleic acid molecules disclosed herein. In some embodiments, the vectors comprise any one or more of the inhibitory nucleic acid molecules disclosed herein and a heterologous nucleic acid. The vectors can be viral or nonviral vectors capable of transporting a nucleic acid molecule. In some embodiments, the vector is a plasmid or cosmid (such as, for example, a circular double-stranded DNA into which additional DNA segments can be ligated). In some embodiments, the vector is a viral vector, wherein additional DNA segments can be ligated into the viral genome. Expression vectors include, but are not limited to, plasmids, cosmids, retroviruses, adenoviruses, adeno-associated viruses (AAV), plant viruses such as cauliflower mosaic virus and tobacco mosaic virus, yeast artificial chromosomes (YACs), Epstein-Barr (EBV)-derived episomes, and other expression vectors known in the art.

The present disclosure also provides compositions comprising any one or more of the inhibitory nucleic acid molecules disclosed herein. In some embodiments, the composition is a pharmaceutical composition. In some embodiments, the compositions comprise a carrier and/or excipient. Examples of carriers include, but are not limited to, poly (lactic acid) (PLA) microspheres, poly(D,L-lactic-coglycolic-acid) (PLGA) microspheres, liposomes, micelles, inverse micelles, lipid cochleates, and lipid microtubules. A carrier may comprise a buffered salt solution such as PBS, HBSS, etc.

In some embodiments, the PDE3B inhibitor is described in, for example, PCT Publication No. WO 2002/070469, U.S. Patent Application Publication No. 2020/0247783. In some embodiments, the PDE3B inhibitor is chosen from OPC3911, IBMX, 3-isobutyl-1-methylxanthine, dihydropyridazinone, amrinone, enoximone, cilostamide, milrinone, cilostazol, and levosimendan. In some embodiments, the PDE3B inhibitor is OPC3911. In some embodiments, the PDE3B inhibitor is IBMX. In some embodiments, the PDE3B inhibitor is 3-isobutyl-1-methylxanthine. In some embodiments, the PDE3B inhibitor is dihydropyridazinone. In some embodiments, the PDE3B inhibitor is amrinone. In some embodiments, the PDE3B inhibitor is enoximone. In some embodiments, the PDE3B inhibitor is cilostamide. In some embodiments, the PDE3B inhibitor is milrinone. In some embodiments, the PDE3B inhibitor is cilostazol. In some embodiments, the PDE3B inhibitor is levosimendan.

In some embodiments, the PDE3B inhibitor comprises a nuclease agent that induces one or more nicks or double-strand breaks at a recognition sequence(s) or a DNA-binding protein that binds to a recognition sequence within a PDE3B genomic nucleic acid molecule. The recognition sequence can be located within a coding region of the PDE3B gene, or within regulatory regions that influence the expression of the gene. A recognition sequence of the DNA-binding protein or nuclease agent can be located in an intron, an exon, a promoter, an enhancer, a regulatory region, or any non-protein coding region. The recognition sequence can include or be proximate to the start codon of the PDE3B gene. For example, the recognition sequence can be located about 10, about 20, about 30, about 40, about 50, about 100, about 200, about 300, about 400, about 500, or about 1,000 nucleotides from the start codon. As another example, two or more nuclease agents can be used, each targeting a nuclease recognition sequence including or proximate to the start codon. As another example, two nuclease agents can be used, one targeting a nuclease recognition sequence including or proximate to the start codon, and one targeting a nuclease recognition sequence including or proximate to the stop codon, wherein cleavage by the nuclease agents can result in deletion of the coding region between the two nuclease recognition sequences. Any nuclease agent that induces a nick or double-strand break into a desired recognition sequence can be used in the methods and compositions disclosed herein. Any DNA-binding protein that binds to a desired recognition sequence can be used in the methods and compositions disclosed herein.

Suitable nuclease agents and DNA-binding proteins for use herein include, but are not limited to, zinc finger protein or zinc finger nuclease (ZFN) pair, Transcription Activator-Like Effector (TALE) protein or Transcription Activator-Like Effector Nuclease (TALEN), or Clustered Regularly Interspersed Short Palindromic Repeats (CRISPR)/CRISPR-associated (Cas) systems. The length of the recognition sequence can vary, and includes, for example, recognition sequences that are about 30-36 bp for a zinc finger protein or ZFN pair, about 15-18 bp for each ZFN, about 36 bp for a TALE protein or TALEN, and about 20 bp for a CRISPR/Cas guide RNA.

In some embodiments, CRISPR/Cas systems can be used to modify a PDE3B genomic nucleic acid molecule within a cell. The methods and compositions disclosed herein can employ CRISPR-Cas systems by utilizing CRISPR complexes (comprising a guide RNA (gRNA) complexed with a Cas protein) for site-directed cleavage of PDE3B nucleic acid molecules.

Cas proteins generally comprise at least one RNA recognition or binding domain that can interact with gRNAs. Cas proteins can also comprise nuclease domains (such as, for example, DNase or RNase domains), DNA binding domains, helicase domains, protein-protein interaction domains, dimerization domains, and other domains. Suitable Cas proteins include, for example, a wild type Cas9 protein and a wild type Cpf1 protein (such as, for example, FnCpf1). A Cas protein can have full cleavage activity to create a double-strand break in a PDE3B genomic nucleic acid molecule or it can be a nickase that creates a single-strand break in a PDE3B genomic nucleic acid molecule. Additional examples of Cas proteins include, but are not limited to, Cas1, Cas1B, Cast, Cas3, Cas4, Cas5, Cas5e (CasD), Cas6, Cas6e, Cas6f, Cas7, Cas8a1, Cas8a2, Cas8b, Cas8c, Cas9 (Csn1 or Csx12), Cas10, Cas10d, CasF, CasG, CasH, Csy1, Csy2, Csy3, Cse1 (CasA), Cse2 (CasB), Cse3 (CasE), Cse4 (CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, and Cu1966, and homologs or modified versions thereof. Cas proteins can also be operably linked to heterologous polypeptides as fusion proteins. For example, a Cas protein can be fused to a cleavage domain, an epigenetic modification domain, a transcriptional activation domain, or a transcriptional repressor domain. Cas proteins can be provided in any form. For example, a Cas protein can be provided in the form of a protein, such as a Cas protein complexed with a gRNA. Alternately, a Cas protein can be provided in the form of a nucleic acid molecule encoding the Cas protein, such as an RNA or DNA.

In some embodiments, targeted genetic modifications of PDE3B genomic nucleic acid molecules can be generated by contacting a cell with a Cas protein and one or more gRNAs that hybridize to one or more gRNA recognition sequences within a target genomic locus in the PDE3B genomic nucleic acid molecule. For example, a gRNA recognition sequence can be located within a region of SEQ ID NO:1. The gRNA recognition sequence can include or be proximate to the start codon of a PDE3B genomic nucleic acid molecule or the stop codon of a PDE3B genomic nucleic acid molecule. For example, the gRNA recognition sequence can be located from about 10, from about 20, from about 30, from about 40, from about 50, from about 100, from about 200, from about 300, from about 400, from about 500, or from about 1,000 nucleotides of the start codon or the stop codon.

The gRNA recognition sequences within a target genomic locus in a PDE3B genomic nucleic acid molecule are located near a Protospacer Adjacent Motif (PAM) sequence, which is a 2-6 base pair DNA sequence immediately following the DNA sequence targeted by the Cas9 nuclease. The canonical PAM is the sequence 5'-NGG-3' where "N" is any nucleobase followed by two guanine ("G") nucleobases. gRNAs can transport Cas9 to anywhere in the genome for gene editing, but no editing can occur at any site other than one at which Cas9 recognizes PAM. In addition, 5'-NGA-3' can be a highly efficient non-canonical PAM for human cells. Generally, the PAM is about 2-6 nucleotides downstream of the DNA sequence targeted by the gRNA. The PAM can flank the gRNA recognition sequence. In some embodiments, the gRNA recognition sequence can be flanked on the 3' end by the PAM. In some embodiments, the gRNA recognition sequence can be flanked on the 5' end by the PAM. For example, the cleavage site of Cas proteins can be about 1 to about 10, about 2 to about 5 base pairs, or three base pairs upstream or downstream of the PAM sequence. In some embodiments (such as when Cas9 from S. *pyogenes* or a closely related Cas9 is used), the PAM sequence of the non-complementary strand can be 5'-NGG-3', where N is any DNA nucleotide and is immediately 3' of the gRNA recognition sequence of the non-complementary strand of the target DNA. As such, the PAM sequence of the complementary strand would be 5'-CCN-3', where N is any DNA nucleotide and is immediately 5' of the gRNA recognition sequence of the complementary strand of the target DNA.

A gRNA is an RNA molecule that binds to a Cas protein and targets the Cas protein to a specific location within a PDE3B genomic nucleic acid molecule. An exemplary gRNA is a gRNA effective to direct a Cas enzyme to bind to or cleave a PDE3B genomic nucleic acid molecule, wherein the gRNA comprises a DNA-targeting segment that hybridizes to a gRNA recognition sequence within the PDE3B genomic nucleic acid molecule. Exemplary gRNAs comprise a DNA-targeting segment that hybridizes to a gRNA recognition sequence present within a PDE3B genomic nucleic acid molecule that includes or is proximate to the start codon or the stop codon. For example, a gRNA can be selected such that it hybridizes to a gRNA recognition sequence that is located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the start codon or located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the stop codon. Suitable gRNAs can comprise from about 17 to about 25 nucleotides, from about 17 to about 23 nucleotides, from about 18 to about 22 nucleotides, or from about 19 to about 21 nucleotides. In some embodiments, the gRNAs can comprise 20 nucleotides.

Examples of suitable gRNA recognition sequences located within the human PDE3B reference gene are set forth in Table 2 as SEQ ID NOs:26-34.

TABLE 2

| Guide RNA Recognition Sequences Near PDE3B Variation(s) | | |
|---|---|---|
| Strand | gRNA Recognition Sequence | SEQ ID NO: |
| + | CTGTTGAACAGTCTTCAAGG | 26 |
| + | TGATCTTTTAGTGCTAAATG | 27 |
| - | TCGGCGGCACTGGACAGTCG | 28 |
| + | TTCCTCACCCGGACCAAGCG | 29 |
| - | GATCTCTGCAAGATAACGCT | 30 |
| + | CTGCCGGGCGCGCCTCTCGC | 31 |
| + | TGCCGGGCGCGCCTCTCGCT | 32 |
| - | GGGAGCAGCGCCGCGGCTGC | 33 |
| - | GCCGGGTCCCCGCTTGGTCC | 34 |

The Cas protein and the gRNA form a complex, and the Cas protein cleaves the target PDE3B genomic nucleic acid molecule. The Cas protein can cleave the nucleic acid molecule at a site within or outside of the nucleic acid sequence present in the target PDE3B genomic nucleic acid molecule to which the DNA-targeting segment of a gRNA will bind. For example, formation of a CRISPR complex (comprising a gRNA hybridized to a gRNA recognition sequence and complexed with a Cas protein) can result in cleavage of one or both strands in or near (such as, for example, within 1, 2, 3, 4, 5, 6, 7, 8, 9, 10, 20, 50, or more base pairs from) the nucleic acid sequence present in the PDE3B genomic nucleic acid molecule to which a DNA-targeting segment of a gRNA will bind.

Such methods can result, for example, in a PDE3B genomic nucleic acid molecule in which a region of SEQ ID NO:1 is disrupted, the start codon is disrupted, the stop codon is disrupted, or the coding sequence is disrupted or deleted. Optionally, the cell can be further contacted with one or more additional gRNAs that hybridize to additional gRNA recognition sequences within the target genomic locus in the PDE3B genomic nucleic acid molecule. By contacting the cell with one or more additional gRNAs (such as, for example, a second gRNA that hybridizes to a second gRNA recognition sequence), cleavage by the Cas protein can create two or more double-strand breaks or two or more single-strand breaks.

In some embodiments, the methods of treatment further comprise detecting the presence or absence of a PDE3B predicted loss-of-function or missense variant nucleic acid molecule encoding a human PDE3B polypeptide in a biological sample from the subject. As used throughout the present disclosure, a "PDE3B predicted loss-of-function variant nucleic acid molecule" is any PDE3B nucleic acid molecule (such as, for example, genomic nucleic acid molecule, mRNA molecule, or cDNA molecule) encoding a PDE3B polypeptide having a partial loss-of-function, a complete loss-of-function, a predicted partial loss-of-function, or a predicted complete loss-of-function.

The present disclosure also provides methods of treating a subject with a therapeutic agent that treats or inhibits a liver disease or type 2 diabetes, wherein the subject is suffering from a liver disease or type 2 diabetes. In some embodiments, the methods comprise determining whether the subject has a PDE3B predicted loss-of-function or missense variant nucleic acid molecule encoding a human PDE3B polypeptide by obtaining or having obtained a biological sample from the subject, and performing or having performed a sequence analysis on the biological sample to determine if the subject has a genotype comprising the PDE3B predicted loss-of-function or missense variant nucleic acid molecule. When the subject is PDE3B reference, the therapeutic agent that treats or inhibits a liver disease or type 2 diabetes is administered or continued to be administered to the subject in an amount that is greater than a standard dosage amount, and a PDE3B inhibitor is administered to the subject. When the subject is heterozygous for a PDE3B predicted loss-of-function or missense variant, the therapeutic agent that treats or inhibits a liver disease or type 2 diabetes is administered or continued to be administered to the subject in an amount that is the same as or less than a standard dosage amount, and a PDE3B inhibitor is administered to the subject. The presence of a genotype having the PDE3B predicted loss-of-function or missense variant nucleic acid molecule encoding the human PDE3B polypeptide indicates the subject has a decreased risk of developing a liver disease or type 2 diabetes. In some embodiments, the subject is PDE3B reference. In some embodiments, the subject is heterozygous for a PDE3B predicted loss-of-function or missense variant nucleic acid molecule.

For subjects that are genotyped or determined to be either PDE3B reference or heterozygous for a PDE3B predicted loss-of-function or missense variant, such subjects can be treated with a PDE3B inhibitor, as described herein.

Detecting the presence or absence of a PDE3B predicted loss-of-function or missense variant nucleic acid molecule in a biological sample from a subject and/or determining whether a subject has a PDE3B predicted loss-of-function or missense variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

In some embodiments, when the subject is PDE3B reference, the subject is also administered a therapeutic agent that treats or inhibits liver disease or type 2 diabetes in an amount that is greater than a standard dosage amount. In some embodiments, when the subject is heterozygous for a PDE3B predicted loss-of-function or missense variant, the subject is also administered a therapeutic agent that treats or inhibits liver disease or type 2 diabetes in a dosage amount that is the same as or less than a standard dosage amount.

In some embodiments, the treatment methods further comprise detecting the presence or absence of a PDE3B predicted loss-of-function polypeptide in a biological sample from the subject. In some embodiments, when the subject does not have a PDE3B predicted loss-of-function polypeptide, the subject is also administered a therapeutic agent that treats or inhibits liver disease or type 2 diabetes in an amount that is greater than a standard dosage amount. In some embodiments, when the subject has a PDE3B predicted loss-of-function polypeptide, the subject is also administered a therapeutic agent that treats or inhibits liver disease or type 2 diabetes in a dosage amount that is the same as or less than a standard dosage amount.

The present disclosure also provides methods of treating a subject with a therapeutic agent that treats or inhibits liver disease or type 2 diabetes, wherein the subject is suffering from liver disease or type 2 diabetes. In some embodiments, the method comprises determining whether the subject has a PDE3B predicted loss-of-function polypeptide by obtaining or having obtained a biological sample from the subject, and performing or having performed an assay on the biological sample to determine if the subject has a PDE3B predicted loss-of-function polypeptide. When the subject does not have a PDE3B predicted loss-of-function polypeptide, the therapeutic agent that treats or inhibits liver disease or type 2 diabetes is administered or continued to be administered to the subject in an amount that is greater than a standard dosage amount, and a PDE3B inhibitor is administered to the subject. When the subject has a PDE3B predicted loss-of-function polypeptide, the therapeutic agent that treats or inhibits liver disease or type 2 diabetes is administered or continued to be administered to the subject in an amount that is the same as or less than a standard dosage amount, and a PDE3B inhibitor is administered to the subject. The presence of a PDE3B predicted loss-of-function polypeptide indicates the subject has a decreased risk of developing liver disease or type 2 diabetes. In some embodiments, the subject has a PDE3B predicted loss-of-function polypeptide. In some embodiments, the subject does not have a PDE3B predicted loss-of-function polypeptide.

Detecting the presence or absence of a PDE3B predicted loss-of-function polypeptide in a biological sample from a subject and/or determining whether a subject has a PDE3B predicted loss-of-function polypeptide can be carried out by any of the methods described herein. In some embodiments, these methods can be carried out in vitro. In some embodiments, these methods can be carried out in situ. In some embodiments, these methods can be carried out in vivo. In any of these embodiments, the polypeptide can be present within a cell obtained from the subject.

Examples of therapeutic agents that treat or inhibit liver disease include, but are not limited to: disulfiram, naltrexone, acamprosate, prednisone, azathioprine, penicillamine, trientine, deferoxamine, ciprofloxacin, norofloxacin, ceftriaxone, ofloxacin, amoxicillin-clavulanate, phytonadione, bumetanide, furosemide, hydrochlorothiazide, chlorothiazide, amiloride, triamterene, spironolactone, octreotide, atenolol, metoprolol, nadolol, propranolol, timolol, and carvedilol, or any combination thereof. In some embodiments, the therapeutic agent that treats or inhibits liver disease is disulfiram. In some embodiments, the therapeutic agent that treats or inhibits liver disease is naltrexone. In some embodiments, the therapeutic agent that treats or inhibits liver disease is acamprosate. In some embodiments, the therapeutic agent that treats or inhibits liver disease is prednisone. In some embodiments, the therapeutic agent that treats or inhibits liver disease is azathioprine. In some embodiments, the therapeutic agent that treats or inhibits liver disease is penicillamine. In some embodiments, the therapeutic agent that treats or inhibits liver disease is trientine. In some embodiments, the therapeutic agent that treats or inhibits liver disease is deferoxamine. In some embodiments, the therapeutic agent that treats or inhibits liver disease is ciprofloxacin. In some embodiments, the therapeutic agent that treats or inhibits liver disease is norofloxacin. In some embodiments, the therapeutic agent that treats or inhibits liver disease is ceftriaxone. In some embodiments, the therapeutic agent that treats or inhibits liver disease is ofloxacin. In some embodiments, the therapeutic agent that treats or inhibits liver disease is amoxicillin-clavulanate. In some embodiments, the therapeutic agent that treats or inhibits liver disease is phytonadione. In some embodiments, the therapeutic agent that treats or inhibits liver disease is bumetanide. In some embodiments, the therapeutic agent that treats or inhibits liver disease is furosemide. In some embodiments, the therapeutic agent that treats or inhibits liver disease is hydrochlorothiazide. In some embodiments, the therapeutic agent that treats or inhibits liver disease is chlorothiazide. In some embodiments, the therapeutic agent that treats or inhibits liver disease is amiloride. In some embodiments, the therapeutic agent that treats or inhibits liver disease is triamterene. In some embodiments, the therapeutic agent that treats or inhibits liver disease is spironolactone. In some embodiments, the therapeutic agent that treats or inhibits liver disease is octreotide. In some embodiments, the therapeutic agent that treats or inhibits liver disease is atenolol. In some embodiments, the therapeutic agent that treats or inhibits liver disease is metoprolol. In some embodiments, the therapeutic agent that treats or inhibits liver disease is nadolol. In some embodiments, the therapeutic agent that treats or inhibits liver disease is propranolol. In some embodiments, the therapeutic agent that treats or inhibits liver disease is timolol. In some embodiments, the therapeutic agent that treats or inhibits liver disease is carvedilol.

Examples of therapeutic agents that treat or inhibit type 2 diabetes include, but are not limited to: metformin, insulin, sulfonylureas (such as glyburide, glipizide, and glimepiride), meglitinides (such as repaglinide and nateglinide), thiazolidinediones (such as rosiglitazone and pioglitazone), DPP-4 inhibitors (such as sitagliptin, saxagliptin, and linagliptin), GLP-1 receptor agonists (such as exenatide, liraglutide, and semagiutide), and SGLT2 inhibitors (such as canagliflozin, dapagliflozin, and empagliflozin). In some embodiments, the therapeutic agent is metformin, insulin, glyburide, glipizide, glimepiride, repaglinide, nateglinide, rosiglitazone, pioglitazone, sitagliptin, saxagliptin, linagliptin, exenatide, liraglutide, semaglutide, canagliflozin, dapagliflozin, or empagliflozin. In some embodiments, the therapeutic agent is metformin. In some embodiments, the therapeutic agent is insulin. In some embodiments, the therapeutic agent is glyburide. In some embodiments, the therapeutic agent is glipizide. In some embodiments, the therapeutic agent is glimepiride. In some embodiments, the therapeutic agent is repaglinide. In some embodiments, the therapeutic agent is nateglinide. In some embodiments, the therapeutic agent is rosiglitazone. In some embodiments, the therapeutic agent is pioglitazone. In some embodiments, the therapeutic agent is sitagliptin. In some embodiments, the therapeutic agent is saxagliptin. In some embodiments, the therapeutic agent is linagliptin. In some embodiments, the therapeutic agent is exenatide. In some embodiments, the therapeutic agent is liraglutide. In some embodiments, the therapeutic agent is semaglutide. In some embodiments, the therapeutic agent is canagliflozin. In some embodiments, the therapeutic agent is dapagliflozin. In some embodiments, the therapeutic agent is empagliflozin.

Examples of therapeutic agents that treat or inhibit liver cirrhosis include, but are not limited to: disulfiram, naltrexone, acamprosate, corticosteroids (such as prednisone and azathioprine), antiviral agents (such as interferons, protease inhibitors, and reverse transcriptase inhibitors), chelating agents (such as penicillamine, trientine, and deferoxamine), diuretics (such as bumetanide, furosemide, hydrochlorothiazide, chlorothiazide, amiloride, triamterene, and spironolactone), and beta-blockers (such as atenolol, metoprolol, nadolol, propranolol, timolol, and carvedilol). In some embodiments, the therapeutic agent that treats or inhibits liver cirrhosis is disulfiram. In some embodiments, the therapeutic agent that treats or inhibits liver cirrhosis is naltrexone. In some embodiments, the therapeutic agent that treats or inhibits liver cirrhosis is acamprosate. In some embodiments, the therapeutic agent that treats or inhibits liver cirrhosis is a corticosteroid (such as prednisone and azathioprine). In some embodiments, the therapeutic agent that treats or inhibits liver cirrhosis is an antiviral agent (such as interferons, protease inhibitors, and reverse transcriptase inhibitors). In some embodiments, the therapeutic agent that treats or inhibits liver cirrhosis is a chelating agent (such as penicillamine, trientine, and deferoxamine). In some embodiments, the therapeutic agent that treats or inhibits liver cirrhosis is a diuretic (such as bumetanide, furosemide, hydrochlorothiazide, chlorothiazide, amiloride, triamterene, and spironolactone). In some embodiments, the therapeutic agent that treats or inhibits liver cirrhosis is a beta-blocker (such as atenolol, metoprolol, nadolol, propranolol, timolol, and carvedilol).

Additional examples of liver disease therapeutic agents (e.g., for use in nonalcoholic fatty liver disease) include, but are not limited to, weight loss inducing agents such as orlistat or sibutramine; insulin sensitizing agents such as thiazolidinediones (TZDs), metformin, and meglitinides; lipid lowering agents such as statins, fibrates, and omega-3 fatty acids; anti-oxidants such as, vitamin E, betaine, N-Acetyl-cysteine, lecithin, silymarin, and beta-carotene; anti TNF agents such as pentoxifylline; probiotics, such as VSL #3; and cytoprotective agents such as ursodeoxycholic acid (UDCA); ACE inhibitors/ARBs, oligofructose, and Incretin analogs. In some embodiments, the therapeutic agent for treating nonalcoholic fatty liver disease is a weight loss inducing agent (such as orlistat or sibutramine). In some embodiments, the therapeutic agent for treating nonalcoholic fatty liver disease is an insulin sensitizing agent (such as thiazolidinediones (TZDs), metformin, and meglitinides). In some embodiments, the therapeutic agent for treating nonalcoholic fatty liver disease is a lipid lowering agent (such as statins, fibrates, and omega-3 fatty acids). In some embodiments, the therapeutic agent for treating nonalcoholic fatty liver disease is an antioxidant such as vitamin E, betaine, N-Acetyl-cysteine, lecithin, silymarin, and beta-carotene. In some embodiments, the therapeutic agent for treating nonalcoholic fatty liver disease is an anti TNF agent (such as pentoxifylline). In some embodiments, the therapeutic agent for treating nonalcoholic fatty liver disease is a probiotic (such as VSL #3). In some embodiments, the therapeutic agent for treating nonalcoholic fatty liver disease is a cytoprotective agent (such as ursodeoxycholic acid (UDCA)). In some embodiments, the therapeutic agent for treating nonalcoholic fatty liver disease is an ACE inhibitors/ARBs. In some embodiments, the therapeutic agent for treating nonalcoholic fatty liver disease is oligofructose. In some embodiments, the therapeutic agent for treating nonalcoholic fatty liver disease is an Incretin analog.

Additional examples of liver disease therapeutic agents (e.g., for use in NASH) include, but are not limited to, OCALIVA® (obeticholic acid), Selonsertib, Elafibranor, Cenicriviroc, GR_MD_02, MGL_3196, IMM_124E, arachidyl amido cholanoic acid (ARAMCHOL™), GS0976, Emricasan, Volixibat, NGM282, GS9674, Tropifexor, MN_001, LMB763, BI_1467335, MSDC_0602, PF_05221304, DF102, Saroglitazar, BMS986036, Lanifibranor, Semaglutide, Nitazoxanide, GRI_0621, EYP001, VK2809, Nalmefene, LIK066, MT_3995, Elobixibat, Namodenoson, Foralumab, SAR425899, Sotagliflozin, EDP_305, Isosabutate, Gemcabene, TERN_101, KBP_042, PF_06865571, DUR928, PF_06835919, NGM313, BMS_986171, Namacizumab, CER_209, ND_L02_s0201, RTU_1096, DRX_065, IONIS_DGAT2Rx, INT_767, NC_001, Seladepar, PXL770, TERN_201, NV556, AZD2693, SP_1373, VK0214, Hepastem, TGFTX4, RLBN1127, GKT_137831, RYI_018, CB4209-CB4211, and JH_0920.

In addition, a subject may be treated with bariatric surgery and/or dietary intervention.

Additional examples of liver disease therapeutic agents (e.g., for use in chronic hepatitis C treatment) include, but are not limited to, ribavirin, paritaprevir, OLYSIO™ (simeprevir), grazoprevir, ledipasvir, ombitasvir, elbasvir, DAKLINZA® (daclatasvir), dasabuvir, ritonavir, sofosbuvir, velpatasvir, voxilaprevir, glecaprevir, pibrentasvir, peginterferon alfa-2a, peginterferon alfa-2b, and interferon alfa-2b.

In some embodiments, the dose of the therapeutic agents that treat or inhibit liver diseases or type 2 diabetes can be decreased by about 10%, by about 20%, by about 30%, by about 40%, by about 50%, by about 60%, by about 70%, by about 80%, or by about 90% for subjects that are heterozygous for a PDE3B predicted loss-of-function or missense variant (i.e., a less than the standard dosage amount) compared to subjects that are PDE3B reference (who may receive an amount that is greater than a standard dosage amount). In some embodiments, the dose of the therapeutic agents that treat or inhibit liver diseases or type 2 diabetes can be decreased by about 10%, by about 20%, by about 30%, by about 40%, or by about 50%. In addition, the subjects that are heterozygous for a PDE3B predicted loss-of-function or missense variant can be administered less frequently compared to subjects that are PDE3B reference.

In some embodiments, the dose of the therapeutic agents that treat or inhibit a liver disease or type 2 diabetes can be decreased by about 10%, by about 20%, by about 30%, by about 40%, by about 50%, for subjects that are homozygous for a PDE3B predicted loss-of-function or missense variant nucleic acid molecule compared to subjects that are heterozygous for a PDE3B predicted loss-of-function or missense variant nucleic acid molecule. In some embodiments, the dose of the therapeutic agents that treat or inhibit a liver disease or type 2 diabetes can be decreased by about 10%, by about 20%, by about 30%, by about 40%, by about 50%. In addition, the dose of therapeutic agents that treat or inhibit liver disease or type 2 diabetes in subjects that are homozygous for a PDE3B predicted loss-of-function or missense variant nucleic acid molecule can be administered less frequently compared to subjects that are heterozygous for a PDE3B predicted loss-of-function or missense variant nucleic acid molecule.

Administration of the therapeutic agents that treat or inhibit liver diseases or type 2 diabetes and/or PDE3B inhibitors can be repeated, for example, after one day, two days, three days, five days, one week, two weeks, three weeks, one month, five weeks, six weeks, seven weeks, eight weeks, two months, or three months. The repeated administration can be at the same dose or at a different dose. The administration can be repeated once, twice, three times, four times, five times, six times, seven times, eight times, nine times, ten times, or more. For example, according to certain dosage regimens a subject can receive therapy for a prolonged period of time such as, for example, 6 months, 1 year, or more. Administration of the therapeutic agents that treat or inhibit liver diseases or type 2 diabetes and/or PDE3B inhibitors can occur by any suitable route including, but not limited to, parenteral, intravenous, oral, subcutaneous, intraarterial, intracranial, intrathecal, intraperitoneal, topical, intranasal, or intramuscular. Pharmaceutical compositions for administration are desirably sterile and substantially isotonic and manufactured under GMP conditions. Pharmaceutical compositions can be provided in unit dosage form (i.e., the dosage for a single administration). Pharmaceutical compositions can be formulated using one or more physiologically and pharmaceutically acceptable carriers, diluents, excipients or auxiliaries. The formulation depends on the route of administration chosen. The term "pharmaceutically acceptable" means that the carrier, diluent, excipient, or auxiliary is compatible with the other ingredients of the formulation and not substantially deleterious to the recipient thereof.

The terms "treat", "treating", and "treatment" and "prevent", "preventing", and "prevention" as used herein, refer to eliciting the desired biological response, such as a therapeutic and prophylactic effect, respectively. In some embodiments, a therapeutic effect comprises one or more of a decrease/reduction in liver diseases or type 2 diabetes, a decrease/reduction in the severity of liver diseases or type 2 diabetes (such as, for example, a reduction or inhibition of development or liver diseases), a decrease/reduction in symptoms and liver disease-related effects or type 2 diabetes-related effects, delaying the onset of symptoms and liver disease-related effects or type 2 diabetes-related effects, reducing the severity of symptoms of liver disease-related effects or type 2 diabetes-related effects, reducing the number of symptoms and liver disease-related effects or type 2 diabetes-related effects, reducing the latency of symptoms and liver disease-related effects or type 2 diabetes-related effects, an amelioration of symptoms and liver disease-related effects or type 2 diabetes-related effects, reducing secondary symptoms, reducing secondary infections, preventing relapse to liver diseases or type 2 diabetes, decreasing the number or frequency of relapse episodes, increasing latency between symptomatic episodes, increasing time to sustained progression, speeding recovery, or increasing efficacy of or decreasing resistance to alternative therapeutics, and/or an increased survival time of the affected host animal, following administration of the agent or composition comprising the agent. A prophylactic effect may comprise a complete or partial avoidance/inhibition or a delay of liver diseases or type 2 diabetes development/progression (such as, for example, a complete or partial avoidance/inhibition or a delay), and an increased survival time of the affected host animal, following administration of a therapeutic protocol. Treatment of liver diseases or type 2 diabetes encompasses the treatment of subjects already diagnosed as having any form of liver diseases or type 2 diabetes at any clinical stage or manifestation, the delay of the onset or evolution or aggravation or deterioration of the symptoms or signs of liver diseases or type 2 diabetes, and/or preventing and/or reducing the severity of liver diseases or type 2 diabetes.

The present disclosure also provides methods of identifying a subject having an increased risk of developing a liver disease or type 2 diabetes. In some embodiments, the method comprises determining or having determined in a biological sample obtained from the subject the presence or absence of a PDE3B predicted loss-of-function or missense variant nucleic acid molecule (such as a genomic nucleic acid molecule, mRNA molecule, and/or cDNA molecule) encoding a human PDE3B polypeptide. When the subject lacks a PDE3B predicted loss-of-function or missense variant nucleic acid molecule (i.e., the subject is genotypically categorized as a PDE3B reference), then the subject has an increased risk of developing a liver disease or type 2 diabetes. When the subject has a PDE3B predicted loss-of-function or missense variant nucleic acid molecule (i.e., the subject is heterozygous for a PDE3B predicted loss-of-function or missense variant or homozygous for a PDE3B predicted loss-of-function or missense variant), then the subject has a decreased risk of developing a liver disease or type 2 diabetes. In some embodiments, liver expression quantitative trait loci (eQTL) can be analyzed.

Having a single copy of a PDE3B predicted loss-of-function or missense variant nucleic acid molecule is more protective of a subject from developing a liver disease or type 2 diabetes than having no copies of a PDE3B predicted loss-of-function or missense variant nucleic acid molecule. Without intending to be limited to any particular theory or mechanism of action, it is believed that a single copy of a PDE3B predicted loss-of-function or missense variant nucleic acid molecule (i.e., heterozygous for a PDE3B predicted loss-of-function or missense variant) is protective of a subject from developing a liver disease or type 2 diabetes, and it is also believed that having two copies of a PDE3B predicted loss-of-function or missense variant nucleic acid molecule (i.e., homozygous for a PDE3B predicted loss-of-function or missense variant) may be more protective of a subject from developing a liver disease or type 2 diabetes, relative to a subject with a single copy. Thus, in some embodiments, a single copy of a PDE3B predicted loss-of-function or missense variant nucleic acid molecule may not be completely protective, but instead, may be partially or incompletely protective of a subject from developing a liver disease or type 2 diabetes. While not desiring to be bound by any particular theory, there may be additional factors or molecules involved in the development of liver diseases or type 2 diabetes that are still present in a subject having a single copy of a PDE3B predicted loss-of-function or missense variant nucleic acid molecule, thus resulting in less than complete protection from the development of liver diseases or type 2 diabetes.

Determining whether a subject has a PDE3B predicted loss-of-function or missense variant nucleic acid molecule in a biological sample from a subject and/or determining whether a subject has a PDE3B predicted loss-of-function or missense variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

In some embodiments, when a subject is identified as having an increased risk of developing a liver disease or type 2 diabetes, the subject is further treated with a therapeutic agent that treats or inhibits liver diseases or type 2 diabetes, and/or a PDE3B inhibitor, as described herein. For example, when the subject is PDE3B reference, and therefore has an increased risk of developing a liver disease or type 2 diabetes, the subject is administered a PDE3B inhibitor. In some embodiments, such a subject is also administered a therapeutic agent that treats or inhibits liver diseases or type 2 diabetes. In some embodiments, when the subject is heterozygous for a PDE3B predicted loss-of-function or missense variant nucleic acid molecule, the subject is administered the therapeutic agent that treats or inhibits liver diseases or type 2 diabetes in a dosage amount that is the same as or less than a standard dosage amount, and is also administered a PDE3B inhibitor. In some embodiments, such a subject is also administered a therapeutic agent that treats or inhibits liver diseases or type 2 diabetes. In some embodiments, when the subject is homozygous for a PDE3B predicted loss-of-function or missense variant nucleic acid molecule, the subject is administered the therapeutic agent that treats or inhibits liver diseases or type 2 diabetes in a dosage amount that is the same as or less than a standard dosage amount. In some embodiments, the subject is PDE3B reference. In some embodiments, the subject is heterozygous for a PDE3B predicted loss-of-function or missense variant nucleic acid molecule. In some embodiments, the subject is homozygous for a PDE3B predicted loss-of-function or missense variant nucleic acid molecule.

In some embodiments, any of the methods described herein can further comprise determining the subject's aggregate burden of having a PDE3B predicted loss-of-function or missense variant genomic nucleic acid molecule, mRNA molecule, or cDNA molecule produced from an mRNA molecule, and/or a PDE3B predicted loss-of-function variant polypeptide associated with a decreased risk of developing liver disease or type 2 diabetes. The aggregate burden is the sum of all variants in the PDE3B gene (including any genetic variants, regardless of their genomic annotation, in proximity to the PDE3B gene—up to 10 Mb around the gene), which can be carried out in an association analysis with liver disease or type 2 diabetes. In some embodiments, the subject is homozygous for one or more PDE3B predicted loss-of-function or missense variant nucleic acid molecules associated with a decreased risk of developing liver disease or type 2 diabetes. In some embodiments, the subject is heterozygous for one or more PDE3B predicted loss-of-function or missense variant nucleic acid molecules associated with a decreased risk of developing liver disease or type 2 diabetes. The result of the association analysis suggests that PDE3B predicted loss-of-function and missense variants are associated with decreased risk of developing liver disease or type 2 diabetes. When the subject has a lower aggregate burden, the subject is at a higher risk of developing a liver disease or type 2 diabetes and the subject is administered or continued to be administered the therapeutic agent that treats or inhibits liver disease or type 2 diabetes in an amount that is greater than a standard dosage amount.

When the subject has a greater aggregate burden, the subject is at a lower risk of developing a liver disease or type 2 diabetes and the subject is administered or continued to be administered the therapeutic agent that treats or inhibits liver disease or type 2 diabetes in an amount that is the same as or less than the standard dosage amount. The greater the aggregate burden, the lower the risk of developing liver disease or type 2 diabetes.

In some embodiments, the subject's aggregate burden of having any one or more PDE3B predicted loss-of-function or missense variant nucleic acid molecules represents a weighted sum of a plurality of any of the PDE3B predicted loss-of-function or missense variant nucleic acid molecules. In some embodiments, the aggregate burden is calculated using at least about 2, at least about 3, at least about 4, at least about 5, at least about 10, at least about 20, at least about 30, at least about 40, at least about 50, at least about 60, at least about 70, at least about 80, at least about 100, at least about 120, at least about 150, at least about 200, at least about 250, at least about 300, at least about 400, at least about 500, at least about 1,000, at least about 10,000, at least about 100,000, or at least about or more than 1,000,000 genetic variants present in or around (up to 10 Mb) the PDE3B gene where the genetic burden is the number of alleles multiplied by the association estimate with liver disease or related outcome for each allele (e.g., a weighted polygenic burden score). This can include any genetic variants, regardless of their genomic annotation, in proximity to the PDE3B gene (up to 10 Mb around the gene) that show a non-zero association with liver-related traits in a genetic association analysis. In some embodiments, when the subject has an aggregate burden above a desired threshold score, the subject has a decreased risk of developing a liver disease or type 2 diabetes. In some embodiments, when the subject has an aggregate burden below a desired threshold score, the subject has an increased risk of developing a liver disease or type 2 diabetes.

In some embodiments, the aggregate burden may be divided into quintiles, e.g., top quintile, intermediate quintile, and bottom quintile, wherein the top quintile of aggregate burden corresponds to the lowest risk group and the bottom quintile of aggregate burden corresponds to the highest risk group. In some embodiments, a subject having a greater aggregate burden comprises the highest weighted aggregate burdens, including, but not limited to the top 10%, top 20%, top 30%, top 40%, or top 50% of aggregate burdens from a subject population. In some embodiments, the genetic variants comprise the genetic variants having association with a liver disease or type 2 diabetes in the top 10%, top 20%, top 30%, top 40%, or top 50% of p-value range for the association. In some embodiments, each of the identified genetic variants comprise the genetic variants having association with a liver disease or type 2 diabetes with p-value of no more than about $10^{-2}$, about $10^{-3}$, about $10^{-4}$, about $10^{-5}$, about $10^{-6}$, about $10^{-7}$, about $10^{-8}$, about $10^{-9}$, about $10^{-10}$, about $10^{-11}$, about $10^{-12}$, about $10^{-13}$, about $10^{-14}$, about or $10^{-15}$. In some embodiments, the identified genetic variants comprise the genetic variants having association with a liver disease or type 2 diabetes with p-value of less than $5\times10^{-8}$. In some embodiments, the identified genetic variants comprise genetic variants having association with a liver disease or type 2 diabetes in high-risk subjects as compared to the rest of the reference population with odds ratio (OR) about 1.001 or greater, about 1.01 or greater, about 1.1 or greater, about 1.5 or greater, about 1.75 or greater, about 2.0 or greater, or about 2.25 or greater for the top 20% of the distribution; or about 1.5 or greater, about 1.75 or greater, about 2.0 or greater, about 2.25 or greater, about 2.5 or greater, or about 2.75 or greater. In some embodiments, the odds ratio (OR) may range from about 1.001 to about 1.01, from about 1.01 to about 1.1, from about 1.0 to about 1.5, from about 1.5 to about 2.0, from about 2.0 to about 2.5, from about 2.5 to about 3.0, from about 3.0 to about 3.5, from about 3.5 to about 4.0, from about 4.0 to about 4.5, from about 4.5 to about 5.0, from about 5.0 to about 5.5, from about 5.5 to about 6.0, from about 6.0 to about 6.5, from about 6.5 to about 7.0, or greater than 7.0. In some embodiments, high-risk subjects comprise subjects having aggregate burdens in the bottom decile, quintile, or tertile in a reference population. The threshold of the aggregate burden is determined on the basis of the nature of the intended practical application and the risk difference that would be considered meaningful for that practical application.

In some embodiments, when a subject is identified as having an increased risk of developing liver disease or type 2 diabetes, the subject is further treated with a therapeutic agent that treats or inhibits liver disease or type 2 diabetes, and/or a PDE3B inhibitor, as described herein. For example, when the subject is PDE3B reference, and therefore has an increased risk of developing liver disease or type 2 diabetes, the subject is administered a PDE3B inhibitor. In some embodiments, such a subject is also administered a therapeutic agent that treats or inhibits liver disease or type 2 diabetes. In some embodiments, when the subject is heterozygous for a PDE3B predicted loss-of-function or missense variant, the subject is administered the therapeutic agent that treats or inhibits liver disease or type 2 diabetes in a dosage amount that is the same as or less than a standard dosage amount, and is also administered a PDE3B inhibitor. In some embodiments, the subject is PDE3B reference. In some embodiments, the subject is heterozygous for a PDE3B predicted loss-of-function or missense variant nucleic acid molecule. Furthermore, when the subject has a lower aggregate burden for having a PDE3B predicted loss-of-function or missense variant nucleic acid molecule, and therefore has an increased risk of developing liver disease or type 2 diabetes, the subject is administered a therapeutic agent that treats or inhibits liver disease or type 2 diabetes in an amount that is greater than a standard dosage amount. In some embodiments, when the subject has a lower aggregate burden for having a PDE3B predicted loss-of-function or missense variant nucleic acid molecule, the subject is administered the therapeutic agent that treats or inhibits liver disease or type 2 diabetes in a dosage amount that is the same as or less than the standard dosage amount administered to a subject who has a greater aggregate burden for having a PDE3B predicted loss-of-function or missense variant nucleic acid molecule.

The present disclosure also provides methods of detecting the presence or absence of a PDE3B predicted loss-of-function or missense variant genomic nucleic acid molecule in a biological sample from a subject, and/or a PDE3B predicted loss-of-function or missense variant mRNA molecule in a biological sample from a subject, and/or a PDE3B predicted loss-of-function or missense variant cDNA molecule produced from an mRNA molecule in a biological sample from a subject. It is understood that gene sequences within a population and mRNA molecules encoded by such genes can vary due to polymorphisms such as single-nucleotide polymorphisms. The sequences provided herein for the PDE3B variant genomic nucleic acid molecule, PDE3B variant mRNA molecule, and PDE3B variant cDNA molecule are only exemplary sequences. Other sequences for the PDE3B variant genomic nucleic acid molecule, variant mRNA molecule, and variant cDNA molecule are also possible.

The biological sample can be derived from any cell, tissue, or biological fluid from the subject. The biological sample may comprise any clinically relevant tissue, such as a bone marrow sample, a tumor biopsy, a fine needle aspirate, or a sample of bodily fluid, such as blood, gingival crevicular fluid, plasma, serum, lymph, ascitic fluid, cystic fluid, or urine. In some cases, the sample comprises a buccal swab. The biological sample used in the methods disclosed herein can vary based on the assay format, nature of the detection method, and the tissues, cells, or extracts that are used as the sample. A biological sample can be processed differently depending on the assay being employed. For example, when detecting any PDE3B variant nucleic acid molecule, preliminary processing designed to isolate or enrich the biological sample for the genomic DNA can be employed. A variety of techniques may be used for this purpose. When detecting the level of any PDE3B variant mRNA molecule, different techniques can be used enrich the biological sample with mRNA molecules. Various methods to detect the presence or level of an mRNA molecule or the presence of a particular variant genomic DNA locus can be used.

In some embodiments, detecting a PDE3B predicted loss-of-function or missense variant nucleic acid molecule in a subject comprises performing a sequence analysis on a biological sample obtained from the subject to determine whether a PDE3B genomic nucleic acid molecule in the biological sample, and/or a PDE3B mRNA molecule in the biological sample, and/or a PDE3B cDNA molecule produced from an mRNA molecule in the biological sample, comprises one or more variations that cause a loss-of-function (partial or complete) or are predicted to cause a loss-of-function (partial or complete).

In some embodiments, the methods of detecting the presence or absence of a PDE3B predicted loss-of-function or missense variant nucleic acid molecule (such as, for example, a genomic nucleic acid molecule, an mRNA molecule, and/or a cDNA molecule produced from an mRNA molecule) in a subject, comprise performing an assay on a biological sample obtained from the subject. The assay determines whether a nucleic acid molecule in the biological sample comprises a particular nucleotide sequence.

In some embodiments, the biological sample comprises a cell or cell lysate. Such methods can further comprise, for example, obtaining a biological sample from the subject comprising a PDE3B genomic nucleic acid molecule or mRNA molecule, and if mRNA, optionally reverse transcribing the mRNA into cDNA. Such assays can comprise, for example determining the identity of these positions of the particular PDE3B nucleic acid molecule. In some embodiments, the method is an in vitro method.

In some embodiments, the determining step, detecting step, or sequence analysis comprises sequencing at least a portion of the nucleotide sequence of the PDE3B genomic nucleic acid molecule, the PDE3B mRNA molecule, or the PDE3B cDNA molecule in the biological sample, wherein the sequenced portion comprises one or more variations that cause a loss-of-function (partial or complete) or are predicted to cause a loss-of-function (partial or complete).

In some embodiments, the assay comprises sequencing the entire nucleic acid molecule. In some embodiments, only a PDE3B genomic nucleic acid molecule is analyzed. In some embodiments, only a PDE3B mRNA is analyzed. In some embodiments, only a PDE3B cDNA obtained from PDE3B mRNA is analyzed.

Alteration-specific polymerase chain reaction techniques can be used to detect mutations such as SNPs in a nucleic acid sequence. Alteration-specific primers can be used because the DNA polymerase will not extend when a mismatch with the template is present.

In some embodiments, the nucleic acid molecule in the sample is mRNA and the mRNA is reverse-transcribed into a cDNA prior to the amplifying step. In some embodiments, the nucleic acid molecule is present within a cell obtained from the subject.

In some embodiments, the assay comprises contacting the biological sample with a primer or probe, such as an alteration-specific primer or alteration-specific probe, that specifically hybridizes to a PDE3B variant genomic sequence, variant mRNA sequence, or variant cDNA sequence and not the corresponding PDE3B reference sequence under stringent conditions, and determining whether hybridization has occurred.

In some embodiments, the determining step, detecting step, or sequence analysis comprises: a) amplifying at least a portion of the nucleic acid molecule that encodes the PDE3B polypeptide; b) labeling the amplified nucleic acid molecule with a detectable label; c) contacting the labeled nucleic acid molecule with a support comprising an alteration-specific probe; and d) detecting the detectable label.

In some embodiments, the assay comprises RNA sequencing (RNA-Seq). In some embodiments, the assays also comprise reverse transcribing mRNA into cDNA, such as by the reverse transcriptase polymerase chain reaction (RT-PCR).

In some embodiments, the methods utilize probes and primers of sufficient nucleotide length to bind to the target nucleotide sequence and specifically detect and/or identify a polynucleotide comprising a PDE3B variant genomic nucleic acid molecule, variant mRNA molecule, or variant cDNA molecule. The hybridization conditions or reaction conditions can be determined by the operator to achieve this result. The nucleotide length may be any length that is sufficient for use in a detection method of choice, including any assay described or exemplified herein. Such probes and primers can hybridize specifically to a target nucleotide sequence under high stringency hybridization conditions. Probes and primers may have complete nucleotide sequence identity of contiguous nucleotides within the target nucleotide sequence, although probes differing from the target nucleotide sequence and that retain the ability to specifically detect and/or identify a target nucleotide sequence may be designed by conventional methods. Probes and primers can have about 80%, about 85%, about 90%, about 91%, about 92%, about 93%, about 94%, about 95%, about 96%, about 97%, about 98%, about 99%, or 100% sequence identity or complementarity with the nucleotide sequence of the target nucleic acid molecule.

Illustrative examples of nucleic acid sequencing techniques include, but are not limited to, chain terminator (Sanger) sequencing and dye terminator sequencing. Other methods involve nucleic acid hybridization methods other than sequencing, including using labeled primers or probes directed against purified DNA, amplified DNA, and fixed cell preparations (fluorescence in situ hybridization (FISH)). In some methods, a target nucleic acid molecule may be amplified prior to or simultaneous with detection. Illustrative examples of nucleic acid amplification techniques include, but are not limited to, polymerase chain reaction (PCR), ligase chain reaction (LCR), strand displacement amplification (SDA), and nucleic acid sequence based amplification (NASBA). Other methods include, but are not limited to, ligase chain reaction, strand displacement amplification, and thermophilic SDA (tSDA).

In hybridization techniques, stringent conditions can be employed such that a probe or primer will specifically hybridize to its target. In some embodiments, a polynucleotide primer or probe under stringent conditions will hybridize to its target sequence to a detectably greater degree than to other non-target sequences, such as, at least 2-fold, at least 3-fold, at least 4-fold, or more over background, including over 10-fold over background. In some embodiments, a polynucleotide primer or probe under stringent conditions will hybridize to its target nucleotide sequence to a detectably greater degree than to other nucleotide sequences by at least 2-fold. In some embodiments, a polynucleotide primer or probe under stringent conditions will hybridize to its target nucleotide sequence to a detectably greater degree than to other nucleotide sequences by at least 3-fold. In some embodiments, a polynucleotide primer or probe under stringent conditions will hybridize to its target nucleotide sequence to a detectably greater degree than to other nucleotide sequences by at least 4-fold. In some embodiments, a polynucleotide primer or probe under stringent conditions will hybridize to its target nucleotide sequence to a detectably greater degree than to other nucleotide sequences by over 10-fold over background. Stringent conditions are sequence-dependent and will be different in different circumstances.

Appropriate stringency conditions which promote DNA hybridization, for example, 6×sodium chloride/sodium citrate (SSC) at about 45° C., followed by a wash of 2×SSC at 50° C., are known or can be found in *Current Protocols in Molecular Biology*, John Wiley & Sons, N.Y. (1989), 6.3.1-6.3.6. Typically, stringent conditions for hybridization and detection will be those in which the salt concentration is less than about 1.5 M Na$^+$ ion, typically about 0.01 to 1.0 M Na$^+$ ion concentration (or other salts) at pH 7.0 to 8.3 and the temperature is at least about 30° C. for short probes (such as, for example, 10 to 50 nucleotides) and at least about 60° C. for longer probes (such as, for example, greater than 50 nucleotides). Stringent conditions may also be achieved with the addition of destabilizing agents such as formamide. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, at least about 100, at least about 200, at least about 300, at least about 400, at least about 500, at least about 600, at least about 700, at least about 800, at least about 900, at least about 1000, at least about 2000, at least about 3000, at least about 4000, or at least about 5000 nucleotides. In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, or at least about 25 nucleotides. In some embodiments, the isolated nucleic acid molecules comprise or consist of at least about 18 nucleotides. In some embodiments, the isolated nucleic acid molecules comprise or consists of at least about 15 nucleotides. In some embodiments, the isolated nucleic acid molecules consist of or comprise from about 10 to about 35, from about 10 to about 30, from about 10 to about 25, from about 12 to about 30, from about 12 to about 28, from about 12 to about 24, from about 15 to about 30, from about 15 to about 25, from about 18 to about 30, from about 18 to about 25, from about 18 to about 24, or from about 18 to about 22 nucleotides. In some embodiments, the isolated nucleic acid molecules consist of or comprise from about 18 to about 30 nucleotides. In some embodiments, the isolated nucleic acid molecules comprise or consist of at least about 15 nucleotides to at least about 35 nucleotides.

In some embodiments, such isolated nucleic acid molecules hybridize to PDE3B variant nucleic acid molecules (such as genomic nucleic acid molecules, mRNA molecules, and/or cDNA molecules) under stringent conditions. Such nucleic acid molecules can be used, for example, as probes, primers, alteration-specific probes, or alteration-specific primers as described or exemplified herein, and include, without limitation primers, probes, antisense RNAs, shRNAs, and siRNAs, each of which is described in more detail elsewhere herein, and can be used in any of the methods described herein.

In some embodiments, the isolated nucleic acid molecules hybridize to at least about 15 contiguous nucleotides of a nucleic acid molecule that is at least about 70%, at least about 75%, at least about 80%, at least about 85%, at least about 90%, at least about 95%, at least about 96%, at least about 97%, at least about 98%, at least about 99%, or 100% identical to PDE3B variant genomic nucleic acid molecules, PDE3B variant mRNA molecules, and/or PDE3B variant cDNA molecules. In some embodiments, the isolated nucleic acid molecules consist of or comprise from about 15 to about 100 nucleotides, or from about 15 to about 35 nucleotides. In some embodiments, the isolated nucleic acid molecules consist of or comprise from about 15 to about 100 nucleotides. In some embodiments, the isolated nucleic acid molecules consist of or comprise from about 15 to about 35 nucleotides.

In some embodiments, the alteration-specific probes and alteration-specific primers comprise DNA. In some embodiments, the alteration-specific probes and alteration-specific primers comprise RNA.

In some embodiments, the probes and primers described herein (including alteration-specific probes and alteration-specific primers) have a nucleotide sequence that specifically hybridizes to any of the nucleic acid molecules disclosed herein, or the complement thereof. In some embodiments, the probes and primers specifically hybridize to any of the nucleic acid molecules disclosed herein under stringent conditions.

In some embodiments, the primers, including alteration-specific primers, can be used in second generation sequencing or high throughput sequencing. In some instances, the primers, including alteration-specific primers, can be modified. In particular, the primers can comprise various modifications that are used at different steps of, for example, Massive Parallel Signature Sequencing (MPSS), Polony sequencing, and 454 Pyrosequencing. Modified primers can be used at several steps of the process, including biotinylated primers in the cloning step and fluorescently labeled primers used at the bead loading step and detection step. Polony sequencing is generally performed using a paired-end tags library wherein each molecule of DNA template is about 135 bp in length. Biotinylated primers are used at the bead loading step and emulsion PCR. Fluorescently labeled degenerate nonamer oligonucleotides are used at the detection step. An adaptor can contain a 5'-biotin tag for immobilization of the DNA library onto streptavidin-coated beads.

The probes and primers described herein can be used to detect a nucleotide variation within any of the PDE3B variant genomic nucleic acid molecules, PDE3B variant mRNA molecules, and/or PDE3B variant cDNA molecules disclosed herein. The primers described herein can be used to amplify PDE3B variant genomic nucleic acid molecules, PDE3B variant mRNA molecules, or PDE3B variant cDNA molecules, or a fragment thereof.

In the context of the disclosure "specifically hybridizes" means that the probe or primer (such as, for example, the alteration-specific probe or alteration-specific primer) does not hybridize to a nucleic acid sequence encoding a PDE3B reference genomic nucleic acid molecule, a PDE3B reference mRNA molecule, and/or a PDE3B reference cDNA molecule.

In some embodiments, the probes (such as, for example, an alteration-specific probe) comprise a label. In some embodiments, the label is a fluorescent label, a radiolabel, or biotin.

The present disclosure also provides supports comprising a substrate to which any one or more of the probes disclosed herein is attached. Solid supports are solid-state substrates or supports with which molecules, such as any of the probes disclosed herein, can be associated. A form of solid support is an array. Another form of solid support is an array detector. An array detector is a solid support to which multiple different probes have been coupled in an array, grid, or other organized pattern. A form for a solid-state substrate is a microtiter dish, such as a standard 96-well type. In some embodiments, a multiwell glass slide can be employed that normally contains one array per well.

The nucleotide sequence of a PDE3B reference genomic nucleic acid molecule is set forth in SEQ ID NO:1 (ENSG00000152270.9 encompassing chr11:14,643,804-14,872,044 in the GRCh38/hg38 human genome assembly).

The nucleotide sequence of a PDE3B reference mRNA molecule is set forth in SEQ ID NO:2. The nucleotide sequence of another PDE3B reference mRNA molecule is set forth in SEQ ID NO:3. The nucleotide sequence of another PDE3B reference mRNA molecule is set forth in SEQ ID NO:4. The nucleotide sequence of a PDE3B reference mRNA molecule is set forth in SEQ ID NO:5. The nucleotide sequence of another PDE3B reference mRNA molecule is set forth in SEQ ID NO:6. The nucleotide sequence of another PDE3B reference mRNA molecule is set forth in SEQ ID NO:7. The nucleotide sequence of a PDE3B reference mRNA molecule is set forth in SEQ ID NO:8. The nucleotide sequence of another PDE3B reference mRNA molecule is set forth in SEQ ID NO:9. The nucleotide sequence of another PDE3B reference mRNA molecule is set forth in SEQ ID NO:10. The nucleotide sequence of another PDE3B reference mRNA molecule is set forth in SEQ ID NO:11.

The nucleotide sequence of a PDE3B reference cDNA molecule is set forth in SEQ ID NO:12. The nucleotide sequence of another PDE3B reference cDNA molecule is set forth in SEQ ID NO:13. The nucleotide sequence of another PDE3B reference cDNA molecule is set forth in SEQ ID NO:14. The nucleotide sequence of a PDE3B reference cDNA molecule is set forth in SEQ ID NO:15. The nucleotide sequence of another PDE3B reference cDNA molecule is set forth in SEQ ID NO:16. The nucleotide sequence of another PDE3B reference cDNA molecule is set forth in SEQ ID NO:17. The nucleotide sequence of another PDE3B reference cDNA molecule is set forth in SEQ ID NO:18. The nucleotide sequence of another PDE3B reference cDNA molecule is set forth in SEQ ID NO:19. The nucleotide sequence of a PDE3B reference cDNA molecule is set forth in SEQ ID NO:20. The nucleotide sequence of another PDE3B reference cDNA molecule is set forth in SEQ ID NO:21.

The amino acid sequence of a PDE3B reference polypeptide is set forth in SEQ ID NO:22. Referring to SEQ ID NO:22, the PDE3B reference polypeptide is 1,112 amino acids in length. The amino acid sequence of a PDE3B reference polypeptide is set forth in SEQ ID NO:23. Referring to SEQ ID NO:23, the PDE3B reference polypeptide is 1,061 amino acids in length. The amino acid sequence of a PDE3B reference polypeptide is set forth in SEQ ID NO:24. Referring to SEQ ID NO:24, the PDE3B reference polypeptide is 1,190 amino acids in length. The amino acid sequence of a PDE3B reference polypeptide is set forth in SEQ ID NO:25. Referring to SEQ ID NO:25, the PDE3B reference polypeptide is 298 amino acids in length.

The genomic nucleic acid molecules, mRNA molecules, and cDNA molecules can be from any organism. For example, the genomic nucleic acid molecules, mRNA molecules, and cDNA molecules can be human or an ortholog from another organism, such as a non-human mammal, a rodent, a mouse, or a rat. It is understood that gene sequences within a population can vary due to polymorphisms such as single-nucleotide polymorphisms. The examples provided herein are only exemplary sequences. Other sequences are also possible.

Also provided herein are functional polynucleotides that can interact with the disclosed nucleic acid molecules. Examples of functional polynucleotides include, but are not limited to, antisense molecules, aptamers, ribozymes, triplex forming molecules, and external guide sequences. The functional polynucleotides can act as effectors, inhibitors, modulators, and stimulators of a specific activity possessed by a target molecule, or the functional polynucleotides can possess a de novo activity independent of any other molecules.

The isolated nucleic acid molecules disclosed herein can comprise RNA, DNA, or both RNA and DNA. The isolated nucleic acid molecules can also be linked or fused to a heterologous nucleic acid sequence, such as in a vector, or a heterologous label. For example, the isolated nucleic acid molecules disclosed herein can be within a vector or as an exogenous donor sequence comprising the isolated nucleic acid molecule and a heterologous nucleic acid sequence. The isolated nucleic acid molecules can also be linked or fused to a heterologous label. The label can be directly detectable (such as, for example, fluorophore) or indirectly detectable (such as, for example, hapten, enzyme, or fluorophore quencher). Such labels can be detectable by spectroscopic, photochemical, biochemical, immunochemical, or chemical means. Such labels include, for example, radiolabels, pigments, dyes, chromogens, spin labels, and fluorescent labels. The label can also be, for example, a chemiluminescent substance; a metal-containing substance; or an enzyme, where there occurs an enzyme-dependent secondary generation of signal. The term "label" can also refer to a "tag" or hapten that can bind selectively to a conjugated molecule such that the conjugated molecule, when added subsequently along with a substrate, is used to generate a detectable signal. For example, biotin can be used as a tag along with an avidin or streptavidin conjugate of horseradish peroxidate (HRP) to bind to the tag, and examined using a calorimetric substrate (such as, for example, tetramethylbenzidine (TMB)) or a fluorogenic substrate to detect the presence of HRP. Exemplary labels that can be used as tags to facilitate purification include, but are not limited to, myc, HA, FLAG or 3XFLAG, 6Xhis or polyhistidine, glutathione-S-transferase (GST), maltose binding protein, an epitope tag, or the Fc portion of immunoglobulin. Numerous labels include, for example, particles, fluorophores, haptens, enzymes and their calorimetric, fluorogenic and chemiluminescent substrates and other labels.

Percent identity (or percent complementarity) between particular stretches of nucleotide sequences within nucleic acid molecules or amino acid sequences within polypeptides can be determined routinely using BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482-489). Herein, if reference is made to percent sequence identity, the higher percentages of sequence identity are preferred over the lower ones.

As used herein, the phrase "corresponding to" or grammatical variations thereof when used in the context of the numbering of a particular nucleotide or nucleotide sequence or position refers to the numbering of a specified reference sequence when the particular nucleotide or nucleotide sequence is compared to a reference sequence (such as, for example, SEQ ID NO:1). In other words, the residue (such as, for example, nucleotide or amino acid) number or residue (such as, for example, nucleotide or amino acid) position of a particular polymer is designated with respect to the reference sequence rather than by the actual numerical position of the residue within the particular nucleotide or nucleotide sequence. For example, a particular nucleotide sequence can be aligned to a reference sequence by introducing gaps to optimize residue matches between the two sequences. In these cases, although the gaps are present, the numbering of the residue in the particular nucleotide or nucleotide sequence is made with respect to the reference sequence to which it has been aligned.

The nucleotide and amino acid sequences listed in the accompanying sequence listing are shown using standard letter abbreviations for nucleotide bases, and three-letter code for amino acids. The nucleotide sequences follow the standard convention of beginning at the 5' end of the sequence and proceeding forward (i.e., from left to right in each line) to the 3' end. Only one strand of each nucleotide sequence is shown, but the complementary strand is understood to be included by any reference to the displayed strand. The amino acid sequence follows the standard convention of beginning at the amino terminus of the sequence and proceeding forward (i.e., from left to right in each line) to the carboxy terminus.

The present disclosure also provides therapeutic agents that treat or inhibit a liver disease or type 2 diabetes for use in the treatment of the liver disease or type 2 diabetes in a subject that is PDE3B reference or that has: a PDE3B predicted loss-of-function or missense variant genomic nucleic acid molecule encoding a PDE3B polypeptide; a PDE3B predicted loss-of-function or missense variant mRNA molecule encoding a PDE3B polypeptide; or a PDE3B predicted loss-of-function or missense variant cDNA molecule encoding a PDE3B polypeptide. Any of the therapeutic agents that treat or inhibit a liver disease or type 2 diabetes described herein can be used in these methods. For treating a PDE3B reference subject, the administered amount of therapeutic agents that treat or inhibit a liver disease or type 2 diabetes is greater than a standard dosage amount. For treating a subject that is heterozygous or homozygous as stated above, the administered amount of therapeutic agents that treat or inhibit a liver disease or type 2 diabetes is less than or the same as a standard dosage amount.

The present disclosure also provides therapeutic agents that treat or inhibit a liver disease or type 2 diabetes for use in the preparation of a medicament for treating a liver disease or type 2 diabetes in a subject that is PDE3B reference or that has: a PDE3B predicted loss-of-function or missense variant genomic nucleic acid molecule encoding a PDE3B polypeptide; a PDE3B predicted loss-of-function or missense variant mRNA molecule encoding a PDE3B polypeptide; or a PDE3B predicted loss-of-function or missense variant cDNA molecule encoding a PDE3B polypeptide. Any of the therapeutic agents that treat or inhibit a liver disease or type 2 diabetes described herein can be used in these methods. For treating a PDE3B reference subject, the administered amount of therapeutic agents that treat or inhibit a liver disease or type 2 diabetes is greater than a standard dosage amount. For treating a subject that is heterozygous or homozygous as stated above, the administered amount of therapeutic agents that treat or inhibit a liver disease or type 2 diabetes is less than or the same as a standard dosage amount.

The present disclosure also provides PDE3B inhibitors that treat or inhibit a liver disease or type 2 diabetes for use in the treatment of the liver disease or type 2 diabetes in a subject that is PDE3B reference or that is heterozygous for: a PDE3B predicted loss-of-function or missense variant genomic nucleic acid molecule encoding a PDE3B polypeptide; a PDE3B predicted loss-of-function or missense variant mRNA molecule encoding a PDE3B polypeptide; or a PDE3B predicted loss-of-function or missense variant cDNA molecule encoding a PDE3B polypeptide. Any of the PDE3B inhibitors described herein can be used in these methods.

The present disclosure also provides PDE3B inhibitors that treat or inhibit a liver disease or type 2 diabetes for use in the preparation of a medicament for treating a liver disease or type 2 diabetes in a subject that is PDE3B reference or that is heterozygous for: a PDE3B predicted loss-of-function or missense variant genomic nucleic acid molecule encoding a PDE3B polypeptide; a PDE3B predicted loss-of-function or missense variant mRNA molecule encoding a PDE3B polypeptide; or a PDE3B predicted loss-of-function or missense variant cDNA molecule encoding a PDE3B polypeptide. Any of the PDE3B inhibitors described herein can be used in these methods.

All patent documents, websites, other publications, accession numbers and the like cited above or below are incorporated by reference in their entirety for all purposes to the same extent as if each individual item were specifically and individually indicated to be so incorporated by reference. If different versions of a sequence are associated with an accession number at different times, the version associated with the accession number at the effective filing date of this application is meant. The effective filing date means the earlier of the actual filing date or filing date of a priority application referring to the accession number if applicable. Likewise, if different versions of a publication, website or the like are published at different times, the version most recently published at the effective filing date of the application is meant unless otherwise indicated. Any feature, step, element, embodiment, or aspect of the present disclosure can be used in combination with any other feature, step, element, embodiment, or aspect unless specifically indicated otherwise. Although the present disclosure has been described in some detail by way of illustration and example for purposes of clarity and understanding, it will be apparent that certain changes and modifications may be practiced within the scope of the appended claims.

The following examples are provided to describe the embodiments in greater detail. They are intended to illustrate, not to limit, the claimed embodiments. The following examples provide those of ordinary skill in the art with a disclosure and description of how the compounds, compositions, articles, devices and/or methods described herein are made and evaluated, and are intended to be purely exemplary and are not intended to limit the scope of any claims. Efforts have been made to ensure accuracy with respect to numbers (such as, for example, amounts, temperature, etc.), but some errors and deviations may be accounted for. Unless indicated otherwise, parts are parts by weight, temperature is in ° C. or is at ambient temperature, and pressure is at or near atmospheric.

EXAMPLES

Example: Loss of Function of the Gene Encoding PDE3B is Associated with Lower Liver Fat, and Lower Risk of Liver Injury, Liver Disease and Type 2 Diabetes Rare nonsynonymous variants in PDE3B have been associated with body fat distribution (Emdin et al., Nat. Commun., 2018, 9, 1613). Because the distribution of body fat is a risk factor for non-alcoholic fatty liver disease, it was hypothesized that rare nonsynonymous variants in this gene may be associated with deposition of fat in the liver and its associated disease outcomes, specifically type 2 diabetes and non-alcoholic fatty liver disease. To test this hypothesis, the associations with these health traits for predicted loss-of-function (pLOF) or predicted deleterious missense variants in PDE3B were estimated in over 500,000 people from multiple cohorts who underwent whole exome sequencing.

Table 3 shows the association with body mass index adjusted waist-to-hip ratio (BMI-adjusted WHR), a measure of fat distribution independent of overall adiposity, for the burden of rare (alternate allele frequency (AAF) <1%) pLOF variants (alone or in combination with predicted-deleterious missense variants) in PDE3B.

TABLE 3

The burden of loss of function or predicted deleterious missense variants of PDE3B is associated with lower BMI-adjusted WHR in UKB and MCPS

| Genetic exposure | Outcome | Per allele beta (95% confidence interval) in SD | P | Genotype counts, RR\|RA\|AA genotypes |
|---|---|---|---|---|
| pLOF; AAF <1% | BMI-adjusted WHR | −0.21 (−0.26, −0.16) | 3.90E−15 | 523,172\|1,298\|0 |

TABLE 3-continued

The burden of loss of function or predicted deleterious missense variants of PDE3B is associated with lower BMI-adjusted WHR in UKB and MCPS

| Genetic exposure | Outcome | Per allele beta (95% confidence interval) in SD | P | Genotype counts, RR\|RA\|AA genotypes |
|---|---|---|---|---|
| pLOF + deleterious missense; AAF <1% | BMI-adjusted WHR | −0.19 (−0.23, −0.15) | 7.80E−22 | 522,197\|2,273\|0 |

Note:
RR indicates the number of individuals in the population studies carrying no alternative alleles; RA indicates the number of individuals carrying one or more heterozygous alternative alleles; AA indicates the number of individuals carrying one or more homozygous alternative alleles; The genetic exposure (or effect allele), is the burden of rare allele causing loss of function (pLOF) or a predicted-deleterious missense variant with an alternative allele frequency less than 1% (AAF <1%).

Rare pLOF variants or pLOF plus deleterious missense variants in PDE3B were strongly associated with lower BMI-adjusted WHR, i.e. with a more favorable body fat distribution. The results show that pLOF variants and predicted deleterious missense variants combined are more strongly associated with fat distribution and have similar effect size compared to pLOF variants alone, indicating that the predicted-deleterious missense variants included in the analysis are likely conferring a loss of function. Hence, the combination of rare predicted loss of function variants and rare deleterious missense variants improves statistical power to study the consequences of genetic loss of function of PDE3B.

Associations with liver fat content, as measured by imaging and liver injury as measured by alanine aminotransferase (ALT), a liver enzyme used in clinical practice as a biomarker of liver injury, were estimated next. Liver fat content was measured by magnetic resonance imaging (MRI) derived proton density fat fraction (PDFF) of the liver. PDFF is defined as the ratio of density of mobile protons from fat (triglycerides) and the total density of protons from mobile triglycerides and mobile water and reflects the concentration of fat within a tissue. Circulating ALT levels indicate leakage from damaged cells due to inflammation or cell death. It was found that the burden of rare pLOF variants or pLOF and predicted deleterious missense variants in PDE3B is associated with lower PDFF and lower circulating ALT levels (Table 4).

TABLE 4

The burden of loss of function or predicted deleterious missense variants in PDE3B is associated with lower liver fat and lower liver damage, as measured by magnetic resonance imaging (MRI) derived proton density fat fraction (PDFF) of the liver and alanine aminotransferase (ALT), respectively

| Genetic exposure | Outcome | Per allele beta (95% confidence interval) | P | Genotype counts, RR\|RA\|AA genotypes |
|---|---|---|---|---|
| pLOF; AAF <1% | PDFF | −0.20 (−0.37, −0.02) | 0.02 | 36,662\|98\|0 |
| pLOF + deleterious missense; AAF <1% | PDFF | −0.16 (−0.29, −0.03) | 0.01 | 36,583\|177\|0 |

TABLE 4-continued

The burden of loss of function or predicted deleterious missense variants in PDE3B is associated with lower liver fat and lower liver damage, as measured by magnetic resonance imaging (MRI) derived proton density fat fraction (PDFF) of the liver and alanine aminotransferase (ALT), respectively

| Genetic exposure | Outcome | Per allele beta (95% confidence interval) | P | Genotype counts, RR\|RA\|AA genotypes |
|---|---|---|---|---|
| pLOF; AAF <1% | ALT | -0.10 (-0.15, -0.05) | 0.0001 | 516,941\|1,370\|0 |
| pLOF + deleterious missense; AAF <1% | ALT | -0.08 (-0.12, -0.04) | 3.4E-05 | 515,859\|2,452\|0 |

Note:
RR indicates the number of individuals in the population studies carrying no alternative alleles; RA indicates the number of individuals carrying one or more heterozygous alternative alleles; AA indicates the number of individuals carrying one or more homozygous alternative alleles; The genetic exposure (or effect allele), is the burden of rare allele causing loss of function (pLOF) or a predicted-deleterious missense variant with an alternative allele frequency less than 1% (AAF <1%).

These results constitute the first evidence linking loss of function of PDE3B with protection from liver fat deposition and liver damage in humans.

Furthermore, it was found that individuals carrying PDE3B loss of function variants and predicted deleterious missense variants have lower risk of developing chronic liver disease in a meta-analysis of multiple cohort studies (Table 5).

TABLE 5

The burden of loss of function or predicted deleterious missense variants of PDE3B is associated with lower odds of clinical diagnosis of liver disease in a meta-analysis of UKB, GHS, SINAI, MDCS and UPENN-PMBB. Associations with non-alcoholic steatohepatitis or liver fibrosis at liver biopsy were estimated in bariatric surgery participants from the GHS cohort

| Genetic exposure | Outcome | OR (95% confidence interval) | P | Genotype counts, RR\|RA\|AA genotypes |
|---|---|---|---|---|
| pLOF; AAF <1% | Non alcoholic liver disease | 0.70 (0.50, 1.00) | 0.04 | Cases: 14,875\|24\|0 Controls: 445,329\|1,226\|0 |
| pLOF + deleterious missense; AAF <1% | Non alcoholic liver disease | 0.78 (0.60, 1.02) | 0.07 | Cases: 14,847\|52\|0 Controls: 444,402\|2,153\|0 |
| pLOF; AAF <1% | Parenchymal Liver Disease | 0.72 (0.51, 1.00) | 0.04 | Cases: 17,020\|28\|0 Controls: 439,215\|1,171\|0 |
| pLOF + deleterious missense; AAF <1% | Parenchymal Liver Disease | 0.81 (0.64, 1.03) | 0.08 | Cases: 16,986\|62\|0 Controls: 438,269\|2,117\|0 |
| pLOF; AAF <1% | Non-alcoholic steatohepatitis or liver fibrosis at liver biopsy in a bariatric surgery cohort from the GHS study | 0.09 (0.01, 1.12) | 0.06 | Cases: 1,395\|3\|0 Controls: 772\|5\|0 |
| pLOF + deleterious missense; AAF <1% | Non-alcoholic steatohepatitis or liver fibrosis at liver biopsy in a bariatric surgery cohort from the GHS study | 0.17 (0.03, 1.01) | 0.05 | Cases: 1,396\|2\|0 Controls: 774\|3\|0 |

Note:
RR indicates the number of individuals in the population studies carrying no alternative alleles; RA indicates the number of individuals carrying one or more heterozygous alternative alleles; AA indicates the number of individuals carrying one or more homozygous alternative alleles; The genetic exposure (or effect allele), is the burden of rare allele causing loss of function (pLOF) or a predicted-deleterious missense variant with an alternative allele frequency less than 1% (AAF <1%); OR indicates odds ratio for the effect allele.

In addition, the results shown an association with lower risk of non-alcoholic steatohepatitis or liver fibrosis in bariatric surgery patients in the GHS study (Table 7). These results constitute the first evidence linking loss of function of PDE3B with protection from chronic liver diseases in humans.

Furthermore, the analyses reveal that carriers of PDE3B loss of function variants and predicted deleterious missense variants have lower risk of type 2 diabetes as shown in Table 6.

TABLE 6

The burden of loss of function or predicted deleterious missense variants of PDE3B is associated with lower risk of type 2 diabetes in a meta-analysis of UKB and GHS

| Genetic exposure | Outcome | OR (95% confidence interval) | P | Genotype counts, RR\|RA\|AA genotypes |
|---|---|---|---|---|
| pLOF; AAF <1% | Type 2 diabetes | 0.78 (0.64, 0.95) | 0.01 | Cases: 53,965\|106\|0 Controls: 483,255\|1,330\|0 |
| pLOF + deleterious missense; AAF <1% | Type 2 diabetes | 0.77 (0.66, 0.89) | 0.0003 | Cases: 53,868\|203\|0 Controls: 482,207\|2,378\|0 |

Note:
RR indicates the number of individuals in the population studies carrying no alternative alleles; RA indicates the number of individuals carrying one or more heterozygous alternative alleles; AA indicates the number of individuals carrying one or more homozygous alternative alleles; The genetic exposure (or effect allele), is the burden of rare allele causing loss of function (pLOF) or a predicted-deleterious missense variant with an alternative allele frequency less than 1% (AAF <1%); OR indicates odds ratio for the effect allele.

These results constitute the first evidence linking loss of function of PDE3B with protection from type 2 diabetes in humans.

Participating Cohorts

Genetic association studies were performed in the United Kingdom Biobank (UKB) cohort (Sudlow et al., PLoS Med, 2015, 12, e1001779) and the DiscoverEHR cohort from the Geisinger Health System (GHS) MyCode Community Health Initiative (Carey et al., Genet. Med., 2016, 18, 906-13). UKB is a population-based cohort study of people aged between 40 and 69 years recruited through 22 testing centers in the UK between 2006-2010. Over 430,000 European ancestry participants from UKB with available whole-exome sequencing and clinical phenotype data were included. The GHS MyCode study Community Health Initiative is a health system-based cohort of patients from Central and Eastern Pennsylvania (USA) recruited in 2007-2019. Over 130,000 European ancestry participants from GHS with available whole-exome sequencing and clinical phenotype data were included. The associations between PDE3B and waist hip ratio were estimated in UKB and the Mexico City Prospective Study (MCPS; Int. J. Epidemiol., 2006, 35, 243-9). The associations with liver outcomes also included the Mount Sinai BioMe Biobank cohort (SINAI, Cell, 2019, 177, 58-69), The University of Pennsylvania Penn Medicine BioBank (UPENN-PMBB; Park et al., 2020, doi:10.1038/s41436-019-0625-8) and Malmo Diet and Cancer Study (MDCS) a Swedish population-based, prospective, observational cohort recruited between 1991 and 1996 (Berglund et al., 1993, doi:10.1111/j.1365-2796.1993.tb00647.x).

Phenotype Definitions

Clinical laboratory measurements for ALT was extracted from electronic health records (EHRs) of participants from GHS. Median values were calculated for all participants with two or more measurements. In UKB, ALT was measured by IFCC (International Federation of Clinical Chemistry) analysis on a Beckman Coulter AU5800 at the baseline visit of the study; Hb1Ac was measured by HPLC using a Bio-Rad VARIANT II Turbo. BMI was calculated by dividing weight in kilograms by the square of height in meters. Waist-to-hip ratio was calculated by dividing waist circumference by hip circumference. Prior to genetic association analysis, continuous phenotype values were transformed by the inverse standard normal function, applied within each ancestry group and separately in men and women.

Disease outcomes were defined according to the International Classification of Diseases, Ninth and Tenth Revision (ICD-9 and ICD-10) using EHRs and self-reports when available and combined into single variables. Individuals with type 2 diabetes were identified using a previously described algorithm (Lotta et al., JAMA, 2018, doi: 10.1001/jama.2018.19329), chronic liver diseases were defined according to definitions listed in Table 7. Individuals with non-alcoholic liver disease and parenchymal liver disease were identified in UKB, GHS, SINAI, UPENN-PMBB and MALMO; individuals with type 2 diabetes were identified in UKB and GHS.

TABLE 7

Definitions of liver disease outcomes

| Liver disease outcome | Case definition | Controls definition |
|---|---|---|
| Non-alcoholic liver disease | ICD10: K721, K740, K741, K742, K746, K758, K760 | ICD10: K70, K71, K72, K73, K74, K75, K76, K77, I81, I85, I982, I983, I864, T864, Z944, C220 OPCS4: G10, G144, J01 f.20002: 1604, 1158, 1141 ALT: >33 IU/L for men and >24 IU/L for women |
| Parenchymal liver disease | ICD10: K70, K71, K72, K73, K74, K753, K753, K752, K754, K758, K759, K760, K767, K7681 OPCS4: G10, G144, J01 UKB.f.20002: 1604, 1158, 1141 | ICD10: K70, K71, K72, K73, K74, K75, K76, K77, I81, I85, I982, I983, I864, T864, Z944, C220 OPCS4: G10, G144, J01 f.20002: 1604, 1158, 1141 ALT: >33 IU/L for men and >24 IU/L for women |

Note:
ICD10 indicates the 10th revision of the International Statistical Classification of Diseases and Related Health Problems; UKB.OPCS4 indicates Office of Population Censuses and Surveys (OPCS) Classification of Interventions and Procedures version 4 as used in the UK Biobank (UKB); UKB.f.20002 indicates self-reported non-cancer illness codes as used in UKB. UKB.f.20004 indicates self-reported medical procedures as used in UKB.

Liver histopathologic phenotype definitions in the GHS bariatric surgery cohort

Wedge biopsies of the liver were obtained intraoperatively during bariatric surgery in 3,779 individuals. The biopsies were consistently obtained 10 cm to the left of falciform ligament prior to any liver retraction or surgery on the stomach. The biopsy was divided into sections, with the primary section delivered to the clinical pathologists for liver histology (fixed in 10% neutral buffered formalin and stained with hematoxylin and eosin for routine histology and Masson's trichrome for assessment of fibrosis) and remaining sections stored within a research biobank (frozen in RNAlater and/or liquid nitrogen). Liver histology was conducted by an experienced pathologist and subsequently re-reviewed by a second experienced pathologist using the NASH Clinical Research Network scoring system as follows: steatosis grade 0 (67%); lobular inflammation grade 0 (no foci), grade 1 (mild, 4 foci per 200×field); fibrosis stage 0 (none), stage 1 (perisinusoidal or periportal fibrosis), stage 2 (perisinusoidal and periportal fibrosis), stage 3 (bridging fibrosis), and stage 4 (cirrhosis). These histologic diagnoses were used to define the following phenotypes: 1) Normal: no evidence of steatosis, NASH, or fibrosis; 2) Simple steatosis: Steatosis (regardless of grade) with no evidence of NASH or fibrosis; 3) NASH: Any presence of lobular inflammation or hepatocyte ballooning (regardless of grade), or any presence of fibrosis (regardless of stage); 4) Fibrosis: Any presence of fibrosis (regardless of stage).

Genotype Data

High coverage whole exome sequencing was performed as previously described (Science, 2016, 354:aaf6814; and Nature, 2020, 586, 749-756) and as summarized below. NimbleGen probes (VCRome; for part of the GHS cohort) or a modified version of the xGen design available from Integrated DNA Technologies (IDT; for the rest of GHS and other cohorts) were used for target sequence capture of the exome. A unique 6 base pair (bp) barcode (VCRome) or 10 bp barcode (IDT) was added to each DNA fragment during library preparation to facilitate multiplexed exome capture and sequencing. Equal amounts of sample were pooled prior to exome capture. Sequencing was performed using 75 bp paired-end reads on Illumina v4 HiSeq 2500 (for part of the GHS cohort) or NovaSeq (for the rest of GHS and other cohorts) instruments. Sequencing had a coverage depth (i.e., number of sequence-reads covering each nucleotide in the target areas of the genome) sufficient to provide greater than 20×coverage over 85% of targeted bases in 96% of VCRome samples and 20×coverage over 90% of targeted bases in 99% of IDT samples. Data processing steps included sample de-multiplexing using Illumina software, alignment to the GRCh38 Human Genome reference sequence including generation of binary alignment and mapping files (BAM), processing of BAM files (e.g., marking of duplicate reads and other read mapping evaluations). Variant calling was performed using the GLNexus system (DOI: 10.1101/343970). Variant mapping and annotation were based on the GRCh38 Human Genome reference sequence and Ensembl v85 gene definitions using the snpEff software. The snpEff predictions that involve protein-coding transcripts with an annotated start and stop were then combined into a single functional impact prediction by selecting the most deleterious functional effect class for each gene. The hierarchy (from most to least deleterious) for these annotations was frameshift, stop-gain, stop-loss, splice acceptor, splice donor, stop-lost, in-frame indel, missense, other annotations. Predicted LOF genetic variants included: a) insertions or deletions resulting in a frameshift, b) insertions, deletions or single nucleotide variants resulting in the introduction of a premature stop codon or in the loss of the transcription start site or stop site, and c) variants in donor or acceptor splice sites. Missense variants were classified for likely functional impact according to the number of in silico prediction algorithms that predicted deleteriousness using SIFT (Adzhubei et al., Nat. Methods, 2010, 7, 248-9) and Polyphen2_HVAR (Adzhubei et al., Nat. Methods, 2010, 7, 248-9), LRT (Chun et al., Genome Res., 2009, 19, 1553-61) and MutationTaster (Schwarz et al., Nat. Methods, 2010, 7, 575-6). For each gene, the alternative allele frequency (AAF) and functional annotation of each variant determined inclusion into these 7 gene burden exposures: 1) pLOF variants with AAF <1%; 2) pLOF or missense variants predicted deleterious by 5/5 algorithms with AAF <1%.

Association analysis of gene burden of rare loss of function variation

Association between the burden of rare predicted loss-of-function or missense variants in a given gene and phenotype was tested by fitting a linear (for quantitative traits) or firth bias-corrected logistic (for binary traits) regression model adjusted for a polygenic score that approximates a genomic kinship matrix using REGENIE v1.0 (doi: doi.org/10.1101/2020.06.19.162354). Analyses were stratified by ancestry and adjusted for age, $age^2$, sex, age-by-sex and $age^2$-by-sex interaction terms, experimental batch-related covariates, 10 common variant-derived principal components, and 20 rare variant-derived principal components. Results across cohorts for each variant-phenotype association were combined using fixed effects inverse variance weighted meta-analysis. In gene burden tests, all individuals are labeled as heterozygotes if they carry one or more qualifying rare variant (as described above based on frequency and functional annotation) and as homozygotes if they carry any qualifying variant in the homozygous state. This "composite genotype" is then used to test for association.

Various modifications of the described subject matter, in addition to those described herein, will be apparent to those skilled in the art from the foregoing description. Such modifications are also intended to fall within the scope of the appended claims. Each reference (including, but not limited to, journal articles, U.S. and non-U.S. patents, patent application publications, international patent application publications, gene bank accession numbers, and the like) cited in the present application is incorporated herein by reference in its entirety and for all purposes.

SEQUENCE LISTING (3210 sequences)

SEQ ID NO: 1 - DNA, 228241 bp, homo sapien
agtcccgagaggtgcccgagggaaaaggaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacaggtatgttagctggaaggcgaggtctgggacgcgagcgggttcgggtttaccgctgcagtttccgagttgaattcgcttatttcaaagcatgttaactttcagaatggaaaaagggtgtgttgcggggggggggggggaggaaataatgttttattctggaaaggattcttaaaatacaggaagccttttaaaaatgcagaagcaagtagcttttgtcattgaatagaaatcaaatagcccgctaatcacatggcactttttaaggactgtatatgcaatagatgagttcgcagaagaatgaggtgaatcatttgtggttgaatagattgactactcccgcttttggcatcctctgatatgtgtctttttggtgccatttatctgtttgctgttataatgatgcctacccaaaaataacatacagcctttagaatgagaggatacatctatgagttttaatcagtgtggtttcgttattgaaaatcgagaggaaaaatctgagattttatcgttacaagacatgagctttgcaaatgagagtaatttagatgaaaagacagcagtataggtgaatataatattttacagattaattcaatgttctttgtatttgttgcataattaggagactgttttaacagtttaaactttaaacttggtaattcctggaaagatgccaaaagcatttccattttttcaccataggtttacatatttttgttttttttttaaaagggattgaaatcattagcaaatgagtttacatctttatatagtattggaaaagctacctgttgtacatcaccaagaaacttaataagtatagttactattattgagcatttatgaagtgcaaaacattttacacatactgtctcagatcctcacaagaacggtgtttggctggtgccattaacctctagagatgagaaatctaggcatatagaggtaacacagcttcacatgtctagttaagtggtagttctgggatttgattagatttttgagttttcagtgctgtgttctgcacgactaactggtaagtatagtggttttaagtaggagagtaagagcgtacaccctaggttttctgaatttttggattagtgatatgctttacactgggagccaatatgttggagacaaaagtttcttgtccttaatgcatttgatgcattcttctctcttcttttctgttctcttccttcacttcttgtctgtcttctcttcgaaataatctccaagctactacattggttttatgacgtgttgaacactgatctgtaatgttccaatgacacaatactttgcttcttgatttggcttcagaggccacttctgtggtcaaccacttgaaaaagttctgttatgccttttgttttctcagtttactaccagtgataatagatagtactttaggaaaatgtgtgtcgggagaaaaattgttttgagaggatttattatggaacaaagtggtatcaactattttcatagaatggaattaattgaattttgaccaaatgtgaacaaattgcattttttaacactggaaaattgttttagcagtttcatcacttttgtgggcaattttcctgaacttaacagttacagtttaacatattttaattgtaatttgttggtgcggtaattctgtctgtcctcttgtaagtggaaaatttctaggcttcttaatcctagtgtggtgctctttccatcacagcatagctatatatgtatatagctataccaggtagcttcaattattgtttatattagaggaaaatacaatttgtgcttctaaagagggtgtaatttcttagtgcagaaaacccttattcacattctacttctaataggaacatttttgcacacttaaagtatatgtgaatagttcagggtttatacatgcctacctaatattctgtctacaaaataattctattttgacattactagaaaagggtatttttaacttagcagatactatcataacaagaatgtttatttatgcttgttccagaagtctaacagtggatttgtgctttttgtttgcatgtatattatgttaaatatattgagaggaaatcagtacttttatggaagtaaaagatcaggagattttctgattttcaaagtgttgtatatgacaatggtaaaaacacttgcttgtttcagaaggtgaaggaagatgaaaagattttagatgggacctgacataggagaaaatgtcctggattcatagacagaggattgaggagtcttggcttaactgtttaattttggaaaagtctgtgaacctttctgaatcttagtatcctgtcaaattaagggatcctagtagatgaattctgtaatatcttctaattctaaaattaaattatataataccttctaattctaaaattaaattcttttagtttacacttttggtaaggtagaaattaaaataaaataagatgtcacaaactagtagttcttgaagttttacttaaatgttgaatgttgaccttgctaacctatactttccaaggtataataattgaaaaagatgagcaaatatcctgtatattttggataggactttaaaaaagtatatgggggttcatttgtaggatggtaacaaaattattacatgttcatttccttaagaatttaaacatttttattaacctctttgaaagccacttaaacttctatcaatagaaatgtttttaattgtagaataatagatttaaagtagtttttaacttttgggatgttatattactgtgttgaaaaataatggcatgtttgtaaaacatttgattttataattagatttataatatttgatttaaatgctatatatgtatcagttcagttcttaactaaggtttttttttttttttggcaaagcatttagagatttgaagcccaaatctaggtgctgttaatggtgttctgctttggtgggttaatggaaagaagcactgagtttgtagtcttatctgccaagaatcagcagaaactaataggaagtttaaaaaaatcagtcgtctgcatagaagctttaatcagaattaaacaagctacatttctatgccattttaattgcatattctacagtgcaattttcagcttttcaatgagatcactttgtgtttgactaggtaaatacaaggttttgaaaggcataagttagtgtgtgagatatttttctatacctttagtgctaagtgctttctaaatggttaggtaaatatttaaaaattccgtggccctaatgcccataaatattacttaaagttttaattttatttgaaaaaggtatacatatgtagtgtgagagcctaaaaaagagagttttttttaaagtgtggttatttactcacctaaggaatttgcaaggcataattccctgttaatttctttaagaatactgtagtatttgtgaaatttattttatggcttcagtgagtgagtgttttattccaatttcatgttactattttgtggtaaaatatcagcctacataataattttatactttattttgtaaatatagtatgtactctgccatgagtattatttttcaaaaacacagatttgatagagtcactctgttttaaaaatctcttatggcttttcattgtccacaggatactgttcatgcccttgacccttgcttgcaaagtccttcataatctgcactctgccattttttgttttatttttttaaaaagcattttattactaatgggacactccctctccacatgcattctagctatttgagggctgcttcttgttattgacattgttgtgggtttttctcttttgattttaacatctccacttgttgaaatctcctttaaggaacaaataagattaggaagactttaggcagtgcactgatactcaaatttatgtataagctgagaacaaattatagcagaatgggccatatttaaaaataaaagttgacaaaccatatgaaacagtgctgatgagtatttccattatagtgcattagatagtcacatctccataatttgtttttatacacttagtagaaggtaaccataagtaaaagcataaagtttgtttttcattgtcatcagactctgtcctcctcagtggcaggcccttctctcattctttctcttttccctttcaattaccaagtcagcttatttccctagcacactcttctaagccttctgtaccccattcaaagcaaaaatttattcttgccgaaaaagcctatttcagtataaatgttggtatagatatataaaatataggacaggttcagagtttatctaatctaattgaaatctgctcattatatattgtacaaggaaaataaattgaactccagagagataaaaatactggctgagggttattctgtgagatatttggaaaacggggactagaacctaggtctttactcctagtccacttttactttccacaaggagcatatatacttcccatcatagccttccaaggctgtacttaattttgccaggtatctccaattatgtgaaaaaaggcagtgtctctggttaaaggaggtaggcaagaagtgagagagagtcagttaagagggactcttgaaaatcctatagtttgtaatgaccttgatgacaaacttctgatacagttatttcagagtaatttgtaaggatgcagctggtcgcaaactcatgtacctacataacatttattttatatgttgaagacagaggggagggtcaaaaggagagtaggaagaatggaagtgaactgactattgcctgcttcgcttaaaggcattcagtttaaacaaaagaaactgaaaaactgttagctaaacaacattttggaagaactgggttctgtctgtgggtggttcctgacagtttataacattgacttgttgttcatcttgttatttacaagctgatctgcacttatttaggttgttgttataagcctgttcttagaacttggggcagaagagtgtatctcccacttttttttttttcttttacaaccaacaactttccttctggcattgatttacctagcagataactttacagatttctcctcctccatctgctacagcacgttctttggccacctcttccttacatttcatacaacttgcattcagcaatgttttttttttttttttttgagacagggtctcactctgttgcccaggctagggtgcagtgatgtgcaatcttgcctcactgcaaactctgccttgcaggctcaagtaatcctcccacctcagcctcctgactaggtgggactgcagtgcgtgccatcatgcccagctaatttttgtatcttttttttgtagagaaggggtttcgctgtgttgcccaggcatgtctcaaactcctgggctctagccatctgcccaccttggccaaagatgtccacatttgagaatatgttaccttatgtggcaaaatggactttggagatgggtttaaggattttgagatgaagatattatccaggattatctgagtgggtgcagtgtaatcatgagggtccttaaaaagtagaagagagaggcagaagagattagagaagatttgacagtggaagcagggttggagtaatacagtgtgatacacatccacccttgggaggctgaggccggagaatggcttgaacccgggaggcggagcttgcagtgagccgagattactcaacccatctttgctagctttggtgatgaaagaaggggaccctgagccaaggaaagcaggcagcctctaagaagatgaaaaaggtaaggaagtagattttttccctagagctcccagaaagtattgaagccccaccagcaccttggtttagcttagtgagacctatatcagacttctgacttgcagacctacgagatacatttgtgttattttatgcctttgaatttgcgataatttgttacaggagcatactagtttgctagggctgccatgacaaagtagcacaaactaggtggcttgaacagcagaaatgaattgtctcaagttctggaggccagaagtccaagatcaagttatctccagggttggttccttttgaaggctgtgagggagaatctgttccatgtctttctcctagcttctggtggtttactggcaatctttggcttgcagatgcatcacgctgatctcattcttcatcttcgcatggcattctccctgtatgttcacatagtctttccctgtacctgtctttgtttccaaattttctaatcttctaaggatccaggtcatattggattggggtccaccctgattatccccgtagagaccttatttcctaataagattacattctgaggtactgaggattaggactcaacatatttttttggggcgatacaattcagcccatgtaggtagaaacagaaaactaaagctacgtaaaattgaattgtttttcaaaatggatgctgaatataaattgatacatttatatttttgctatcagtgagtaagaatgcccctggatccacattcttatcaaccagtgcttcctatttactgacttttaagtttggctagtctagtgggtatgaaatggcatttctttgtgattgtaatctgcatttttctaatttctagatttatatgtatgttgtgatgtagagattcaatctcattttttatccaaatggatatccagtcatgccaacacactatattgaaaagtttatttattctccattcatcagtgctgcctctgtcctatatcaaatttcaatatatgtatgactgtatctgggctctattatgtttgatttgttagtttatgcatcttgtgttaataccacactatcttagttataatagctttctaataagacttaatatcctgtattgatagtgtccattgatgtgcaaaagttttcaattttgatgaagtttatctactttttcttttgttgcctatgattttggtgtcatatcaaataaatcactgcaaattcaatgtaatgaagctctcattctgtgttttctttgaggagttttataaaagttttagttctaatatttaggtctttgattcattttgagttaatttttgtatacaaaattttgtataattacagtgtaaggtaatggtccaactttattcttttgcctgtggatgttacatttttctaagaccatttgttgaaaaaaactgttaataacctttcaacaaagtgttggcttctttgttgaaaattatttgacagtacatgtgaggatttattgctaggctctctgttctatgtcataggtctatacgtctgtgtttctgtcagtaccacactgttttgattattgtatcttttagtaagttttgaaatcatgaagtttgagacctcaaactttgttctttttcaagattattttggctatttgagtgtcctttgagattccaatatgaattttaggatgaatttttctgtttctgcaaaaaatgtcattggggtttattttttattgtggtaaaaaccataaaatttactctgttctttatttttaagtgtacagttcagtggtgttaagtatattcacattgttgtgaaacagatctccctatcttttccatcttgcagaactgacactctatactcattaaataacaactacccttccgctgtcccctgataatcaccgtttgactttatgtttcaatgaatttgaggactttagatacctcatataagtggaatcatacagtatttttttgtgacttgcttatttcacttagtataatcatctttgggattttgatagagattgccttgaatctgtagattgcttttagtagcactggcatcttaacaataataggttttctaatccatgaaaatgggatatcttttgatttatttgtatattaatttatttcagcaatatttcatagttttcagtgtatgagtctttcacctccatggttaagtttattcctgagcattttattcttttcaatgctgttgcagatagaactgttttcttaatttcctttttgaattatttatagtatataactctatgcaactgatttgtatgtgttgatttttatatactgcagctttgctgaatttgtttgttctaatggttttttttggtggaatcttcagggtcttaacttagtttttgatccctaaaattagtgctgcatatgtagactcagaaacctcacgtaaaaatttaaattggcctcaggttggcaatgttccaaggcaatggttagaagcaaattcagattctccaaggcctcaaataattcctacagataaaatcccaaggaaattcagcagtgcctagtcaaaaatccacaaatcaggcaaggtaataaggcactatgaataagaacctaagaaaaagtacacaacaaaaacacatccgccctcgggaggctgaggcaggagaatggcttgaacccgggaggcaaagcttgcagtgagccgacatcatgccactacactccagcctgggcgacagagcaagactccgtctcaaaaaaaaaccaaaaaaaccaacaaaaaaaccacacccaccaaagcttcggattatataagaaatataaaaacacgtttattatgatgaaagaaataaaatagaaacctgaaaaaaatgattgggggacaggtgattaaaaaaactgtcgctggccgagtgtggtggttcatgcttgtaatctcagcactttgggaggccgaggtgggtggatggcttgaatccagaagttcgagaccagcctgggcaacatggcaaaaccctgtctctacaagatacaaaatattagctaggcatggtggcgaatgcctatagtcgcagctacctgggaggctaatgtgggagcatcacctgagctggggaggtcgaggctgcagtgagctctgattgtaccactgcactgctgcctgagtgacagagtgagactctgtctcaagaaaaatcccccaaaaccccaaaacacacacacacaaagttatataggtcagaagagttggagaataagaagtaaagtataacttggacttaattgaagttcgaaaaggggataataaaatggagaggaagaaatattagaaaaaaatgtctgtaaaatagcattttaaagaactgatgaaaaatgccaagtttttgtccagaaagctcactgaatctcaagcagaataaattaaaagaaacccatacattattgcaaaattacagaaccttaaataaaaagataactactaaaagaactcagaaaagagaaatggccttcaaaagaatgaatggcagttttactgaaaggtgacttattagtagccacagtggaatccataaagcagtggaatatcatccgacaggtgctgagagaaaataagtgtcaaactagaaatcagtgccccgcaaaactatctccctaggaaaagtgcaagctaaaacaattttagaaaaggaaaaattgagggagtttttaccactgaaagtacatactcaggcagaagaaatgaatgagatcaagaaggtatactaatgataaatataggtaaaactaaacaaacactgttattataagacattattaacaatgtcttctaagagaacagactagaactaaagtgctagaaaacaatagcatttacattggaaagaagaaattagaagagtatgttaaaaagttatatttcaaggggagggctaagagtttgactttaaatcttgtttatatatacacagcagctgtctacacacacacacacacacacacacacacacacacacacacacacagagctagtgcaactgctgaaagagtagatattgtgtgaatggcttccaaacaaatagaggtgacaaaagaattgagggaaaaaaggagaccaaataattaatatcagagaaaaaaggaggtcaaaaaaggaaacctaggcgaacaggacaaatacttaaagcatgtaaaaagatgatagaaataaatctagatactaccacgaatcacaataaatatagaagcaaaaactttgttaaaagaatataaagattgtccacttggattttctgactgtatactctttgcaaacataagaatttatcaaggttggaaataaaagaatggaaaaaggacacaagacactataataaaactggtaatattaatatcagaaaaactgggaaaacactttgctagagaaaaagatgatcattatgtaattataaaagactgaattcaccaagaagataaaatttaaaattgtagatacctaataacataaatgtctatgtctatatatatacatacacatatatacacacacatataattatttccaaattcacctacagtagaaagcattccttttgtatattttatttatacctttaattcattcctatcacattaatatactcttcttatactgtcttaattacctttcagttattagcccccttttttgagcatctcagtgtgctaggtgctgtgggggaaatataaagatcaataagatatggttctatccctaaggagtttatatctagtagactcagatgtgcagactagctcaccatgagacacaattgtgtaactgctgtgttccagtcgagcacctcattgtggaaggcaaatagtgatcagtttttcgggggagtgtattggaagtctttatagaggaggcatttgaaggacatattatataagacttgattaagtagagacaggcgttgagactggtaaaccatgtgatggtaaaattcatgacattgttgtggaaatcagaatggaaagctagtaaagtgaggagtgtagagttagtgtgggaatgttactggaaaagactggaagattggttgagagtaatgtatggaagatattgaatgccatcctaaactttttgatttattcagtggaagatgttggaagattttcagaagagaagagacattttctttatttagtttagagagattattgacaatgggaaaagtagatcagagaatgaaaatattgggagcagggagcccgttataatcatttatatgagagactgagaacagtgggagtggaaaagccctggtgattggaaaaaaggaggtatgaagatgcttaaagtcttagtgactgaaagtttactggtgtcattagctaatgtagggaacattggaagatgagctggtttgggagaaatgctaaagagcttgactattgattaatgcatgttccagttttcacatgtgaatggttgatacctcttttacatctctaaatgggatgtaaactccctgagtgtaagaactaagcatttctgttttgtatttatcatttacattttggagttcacaatggatatctgttattatatttatacttattgtcatttcttataatgtttccatgttaacctttagtgaagaaaagaactgtgggtggagatggatcccaatttcctactgtctttggtattttccttaatagacagttattgcacagtggtgaagctagactgcttgagtttaaatgtcatctctaccacttacagaatgttggacaagttgtttaacttctctgtaccccagtttctctgtgtataaattaggggtaatcacagtacctatcttattgatgtgaaatagatgtgatatgaaatgttgtgaggattaataacctgtaagttcttggaacagtgtctggcacctggcaagttttcaacagattagttgttatggctgttactattaatagttgaaattctcatccttgaattatttaatagtttatgccaagtttctctaaatcaatggtaaaacgaattgaaatttagatctatgagacaatccgtttttattgtctcgatacttctcttgggactggtattaagcaaaaaagcaaatcctttccataagggattatataggggaaattctttcaacagtggtcagtatttaggacaacaaagaaaagatacaaggagtaatttaaaaagtgattaaaaggggggtaatttggatttattttcttttaaagtttcagagttaaagattaagaacctttggtcttccagaagaaaaatgtgtcagctgctacagtcataatttactgtcccataagctttttgttccagtttgtcactttggagttgggagtacactgggaagtcaaacaaatgtctttacccataattcttccttcacagttcactgtctgttaagcatgttgataactatgcagcacctccccaggaatggtaagagggagataagagatacggaaacagaaagaagagaaactgtatgtaaaaaagtgactcttccaaccctctttttcactccagtcagtattagtcactttactttactgcttcaatgtaacactttgttccacttttcagaaaaagtctcctgaagagcttctaccagttagatagtaatcgttaaaagcagacaaaaataaatatggataggaatttttaccaatatatgggaaaatatttttctttacgggaaaatacttacatacacattactaaataccagtgtttatcattatgtaagtcattttttgtttgtttttgttgtaaaaatatgcaccatctacaaataactttaatacctgaaaactcatttcttcagcagcattactgggcattctgctaggagctataaaggctatgaaaaagaatcacataatgtcattattcttaggagtttaatgtaagataaaaagtgaagattatattttaaataataaaacaggcagtgcaattaatattgtagtgtttgagaggtctcaaaaaataacacccaaattccctgcccaaattttgagaagagagtgacagatgagatatcagaatactacctgtattcctgataaagctgttattcgaaggcatggcttgtatcagtagatagttttgctttctaataccaaaccccagagttaaacagacttccctggtcattagcagaataggaccaggaacattttccctgtttgcctggagagcctatccatggagaagcattggagaacttctgcttccatctagtgggtaggcttccaagagcaaaaaaaggggtagaattatgcttacatgattctttagtctaaacttaccagtcaggtaagtcactatcctccttctaggggataaataagtgaaagggtagagagagtccaaaaatatttagcaacagttcttcctcatagaagccataggattgagaaaaaggcattgcctctctcaacacgataatagaaaaagctatttgaaattctgacatcttttagacaacatatattttaatttttgcttgtcgcctttcttttttttttgagatggagtcctgctcttgtcgcccaggctgaagtgcaatggcactatctcggctcactgcaacctccgtctcctgggttcaaggattctcctgcctcaccctcccaagtagctgggattacaggcatgcgccaacactcccagctaatttttgtatttttagtagagacgggggttttgccatgttggccaggctggtcttgaactcttgacctcgtgatccgcccgcctcggcctcccaaagtgctgagattacaggcatgagccaccgcgccagatgtcacctttcttgtaactatagtgtctatatagttgcatggaatgtacataatttaaaaactgagcctagattctgcctttgttcatttgtttctttcttgacaaaatcaagtcacttatttctgtgcatttattgttgcacttaatattctctatcatatttgggttgataggcctttcctgtctctacattttatgtcctttaaattcagggacagtatcttatttatttatgtgaccctggtgcttggcatatatcaaatagtttattgagttggattattggattaaatactgtttttttaaatcacttcgcaggacatttttttcctagttgatacataatactcataatttcatcactgaaagtaacttgaagaacaggatgcctaaggaataagttcttgatgtcacaaaacccagcaaaaatcttcttcagcaggggaagcttacttaggtgaatgcctcagtttataggtgaagcttggaagaatgttgcaagttgggagaatggaaactaatgcaggacattgtgtgcaggagttgcctctaaaataaaggaggagcatggaatgataatttgaggtgaggtcatagtgaggcagtagggttataaacagttttgacattactttttcagatatggcttgcagagttaaaaattcctagatgtttcaatggttctcagttaacaagtgttgatagaacattttcagtgcttagactgcacttttgatttctagggagaacttcatttttaacataaatttactaattttagtagttcaccaaggaagaagatggtagtaaaatactggtcataattatttagcaaactctggaaatgtgattttttaaaaaaacttttctttaagttcaggggtacatgtgcaggtttgtaaaggtaaacttgtgtcatgggagtttgttgtacagattatttcaccacccaggtattaagcctagtacccattagttatttttcctcatcctgtccctcctcccactccggtaggccccagtgtgtgctgttcctccctacgtggtcatgtgttctcatcaagtacatttttgtcaggtaactgaagtttatctttttacaagtaatatctttttaattcaaacacatttttgctgtgactatttctattatgtttacccctatttctgcttaccctgaatagatcttgatgaaaataatatatttctctgaaaagtaaggattgtcattttaaaaattagtaaacatgtatttgacaaaattattagcaggcacagcagaagcagttcatacaatctgtttggtaaactgagtgatctcccagttctgtgttcccccaaatagttcacccacacattccataaaaggttctctttaggcagatgcaacaataccctgaaggcataattgttagctttatagtcagcattaggcaattaaaatcctccgaaattaattccagacttggctgtaaccctaagagccattctggaagacagaggatgtagagtttacgagatcttatgccctgtttataagggaggggaatatccccaaaatatttaggagagttcacacatactgaatgccactaatttcaacgacaagagcttatttctaatattccttatattattgcttctaatattctttttttttttttttgaggtggggtctcgccctgttgcccaggctggagtgcaatggcatgatctcggctcactgcaacctctgcctcccaggctcaagcgatcctcccacttcagcctctggagtagctggggctacaggcacgtgccaccattcctggctattttttttttgtattttgtagagatgaggttttgctgtgttgcccacgctggtcttgaactcctgagctctagtcatctgcccaccttggcctcccagagtgctgggattgcaggcatgagccactattcctggccccttctaatattctaatactagaatattccttatattattctttctaatatttcttatatttctaatatgccttacattagtctttagggctaataggaatagcttctgaagtgcttataatagctgcttcgggagtgtggcctttctgattaaatgctagctgatcacccttagaatataaattcttgttaaataacatatttacatttaaatagcaagaaaggagaatgtaagcatcctgaagataagaatttttgcctgttttgacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacactgttggtgggactataagtagttcaaccattgtagaagacagtgtgacgattcctcagggatctagaactagaaataccatttgacccagccatcccattactgggtatgtacccaaaggattataaatcatgctgctataaagacacatgcacacatatgtttattgtggcagtattcacaatagcaaagacttggaaccaagccaaatgtccaacaatgatagactggattaagaaaatgtggcggttaagaggaggatagtcgagatggccgaataggaacagctccggtctacagcttccagcgtgagcgacgcaaaagacggttgatttctgcatttccatctgaggtactgggttcatctcactagggagtgccagacagtgggcgtaggacagtgggtgcagcgcaccgtgcacgagccgaagcagggtgaggcattgcctcactcgggaagcgcaaggggtcagggagttccctttcctagtcaaagaaaggggtgacagacggcacctggaaaatcgggtcactcccaccctaatactgcgcttttccgacgggcttaaaaaacggcgcaccacaagattatatcccgcacctggctcggagggtcctagcccacggagtctcactgattgctagcacagcagtctgagatcaaactgcaaggcggcagttaggctggggaaggggcgcctgccatttccgaggcttgcttaggtaaacaaagcagcaggtaagctcgaactgggtggaacccaccacggttcaaggaggcctgcctgcttctgtaggctccacctctgggggcagggcacagacaaacaaaaagacgcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcacccccaagtaggggcagactgacacttcacacggccgggtactcctctgagacaaaacttccagaggaacgatcagacagcaacattcacggttcacaaaaatccgctgttctgcagccaccgctgctgttacccaggcaaacagggtctggagtgcacctctagcaaactccaacagacctgcagctgagggtcctgtctgttagaaggaaaactaacaaacagaaaggacatccacaccaaaaacccatctgtacatcaccatcatcaaagaccagaagtagataaaaccacaaagatggggaaaaaacagagcagaaaaactggaaactctaaaaagcagaacgcctctcctcctccaaaggaactcagctcctcactagcaatggaacaaagctggacggagaatgactttgacgagttgagagaagaaggcttcagacaatgaaactactctgagctacaggaagaaattcaaaccaaaggcaaagaagttgaaaactttgaaaaaaatttagacgaatgtataactagaataaccaatacagagaagtgcttaaaggagctgatggagctgaaagccaaggctcgagaactacgtgaagaatgcagaagccttaggagctgatgcgatcaactggaagaaagggtatcagtgatggaagatgaaatgaatgaactgaagcgagaagggaagtttagagaaaagagaataacaagaaacgaacaaagcctccaagaaatatgggactatgtgaaaagaccaaatctgcgtctgattggtgtacctgaaagtgacggggagaatggaaccaagttggaaaacactctgcaggatattatctaggagaacttccccaatctagcaaggtaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcagcagaaactctacaagccagaagagagtgggggccaatattcaacattcttaaagaaaagaattttcaacccagaatttcatatccatccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagcccctgcaaaatcatgccaaattgtaaagaccatcaaggctaggaagaaactgcatcaactaacgagcaaaataaccagctaacatcataatgacaggatcaaattcacacataacaatattaactttaaatgtaaatgggctaaatgctccaattaaaagacactcctcacttcaaaaaacctgtctcacgtgcagagacacacataggctcaaaataaaaggaaggaggaagatctaccaagccaatggaaaacaaaaaaaggcaggggttgcaatcctagtctctgataaaacagactttaaaccaacaaagatcaaaagagacaaagaaggccattacataagggtaaagggatcaattcaacaagaagagctaactatcctaaatatatatgcacccaatacaggagcacccagattcagaaagcaagtcctgagtaacctacaaagagacttagactcccacacaataataatgggagactttaacaccccactgtcaacattagatcaacaagacagaaagttaacaaggatacccaggaattgaactcatctctgcaccaagcggacctaatagacatctacagaactctccaccccaaatcaacagaatatacatttttttcagcaccacaccacacctattccaaaattgaccacatagttggaagtaaagctctcctcagcaaatgtaaacaagcagaaattataacaagctgtctctcagaccacagtgcaatcaaactagagctcaggattaagaatctcactcaaaaccgctcaactatatggaaactgaacaacctgctcctgaacgactactgggtaaataatgaaatgaaggcagaaataaagatgttctttgaaaccaacgagaacaaagacacaacatatcagaatctctgggacacattcaaagcagtgtgtagagggaaatttatagcagtaaatgcccacaagagaaagtaggaaagatccaaaattgacaccctaatatcacaattaaaagaactagaaaagcaagagcaaacacattcaaaagctagcagaaggcaagaaataactaaaatcagagcagaactgaaggaaatagagtcacaaaaaacacttcaaaaaatcaatgaatccaggagctggttttttgaaaggatcaagaaaattgatagaccgctaacaagactaataaagaagaaaagagagaagaatcaaatagacacaataaaaaatgataaaggggatatcaccaccaatcccacagaaatacaaactaccgtcagaggatactacaaacagctctaagcaaataaactagaaaatctagaagaaagggataaattcctcgacacatacaccctcccaagactaaaccaggaagaagttgactctctgaatagaccaataacaggctctgaaattgtggcaataatcaatagcttaccaaccaaaaagagtccaggaccagatggattcacagccgaattataccagaggtacaaggaggagctggtaccattcctcctgaaactattccaatcaatagaaaaagagggaatcctccctaactcattttatgagaccagcatcatcctgataccaaagccgggcagagacacaacaaaaaaagagaattttagaccaatatccttgatgaacattgatgcaaaaatcctcaataaaatactggcaatccgaatccagcagcacatcaaaaagcttatccaacatgatcaagtgggcttcatccctgggatgcaaggctggttcaatatccgcaaatcaataaatgtaatccagcatataaacagaaccaaagacaaaaaccacatgattatctcaatagatgcagaaaagtcctttgacaaaattcaacaacccttcatgctaaaagctctcaataaattaagtattgatgggacatatctcaaaataataagagctatctatgacagacccacagccaatatcatactgaatgggcaaaaactggaagcattccctttgaaaactggcacaagacagggatgctgtctctcaccactcctattccacatactgttggaagttctagccagggcaattaggcaggagaaggaaataaagggtattcaattaggaaaagaggaagtcaaattgtccctgtttgcagatgacatgattgtatacctagaaaaccccattgtctcagcccaaaatctccttaagctgataagcaacttcagcaaagtctcaggatacaaagtcaatgtacaaaaatcacaagcattcttatacaccaataacagacaaacagagagccaaatcatgagtgaactcccattcacaattgcttcattcacaatttgattcctggaataaaatacctaggaatccaacttacaaaggacatgaaggatctcttcaaggagaactacaaaccactgctcaatgaaataaaagaggatacaaataaatggaagaacattccatgctcatgggtaggaagaatcaatatcgtgaaaatggccatactgcccaaggtaatttatagattcaatgccatccccatcaagctaccaatgactttcttcacagaattggaaaaagctactttaaagttcatatggaatgaaaaaagagcccgcatcgccaagtcaatccaacaccaaaagaacaaagctggaggcatcacactacctgacttcaaactatactacaaggctacactaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccgttcaggacataggcatgggcaaggacttcatgtctaaaacaccaaaagcaatggcaacagaagccaaaattgacaaatgggatctaattaaactcaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacacacaaccccatcaacaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatgacaatcattaaaaagtcaggaaaccacaggtgctggagaggatgtggagaaataggaacacttttacactgttggtgggactgtaaactagttcgaccattgtggaagacagtgtggcaattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggatgaagaaaatatggcacatatacaccatggaatactatgcagccgtaaaaaatgaggagttcatgtcctttgtagggacatggatgaaattggaaatcatcattcccagtaaactatcgcaaggacaaaaaaccaaacaccacatattctcactcataggtgggaattgaacaatgagaacacatggacacaggaaggggaacatcacactctggggactgttgtggggtggggggagtggggagggatagcattaggagatacacctaatgctaaatgacgagttaatgagtgcagcacaccagcatggcacatgtatacacatgtaactaacctgcacattgtgcacatgtaccctaaaacttaaagtataataataataataaaattaaattaaattaaaaaaaagaaaatgtggcacacatacaccatggaatactatgcagccataaaaaaggatgagttcatggccttcgtagggacatggatgaagctggaaaccatcattctcagcaaactgtcgcaaggacaaaaaaccaaacactgcatgttctcactgataggtgggaattgaacaatgagaacacatggacacaggaaggggaacatgacacaacggggactgttgtggggttgggggagggtggagggatagcattaggagatatacctaatgctaaatgacaagttaatgggtgcagcacagcaacatggcacatatatacatatgtaacaaacttgcacgttgtgcacatgtaccctaaaacttaaagtataataataataataataataataataaaagaatttttgtctgttttgttcactgccatgtccaaaataatgcctggtaagagctcaaatagctattgaatgggtaaatatcacactgactttgctgaagtatttaaataattttcagacattataaaaagaaatacattttggccaaaagcttaattaatgcaagagtaaaaaaaaaaaaggtttgaagcatacaatcctatttcagggggctcaagagtttaaaaggaagaaagggggagacatccaggtaagaggacacgtatgctgtctttccaatattggacattatctactttttctgagacagtatcgacgctttgagcatgacacatctttttgtaacagagtcctacttaagctcaatatttaattggtacttagagccaagaaatacatgtgggcctacatttttttgcatgtattttgtgttatagcctctatacaatctaaggacacttggttctttctctcaaaatcctttcctcacttttgagtaatttacttttgaatttataaatacctcaccttattattcatcatattatttgcattatgttaaaccctggtcaacccttaaaatgttaaaggaaagacattactatattttttaatgaatacactaaacttttaagtacaaatatatttgtcatcagcctctgcaaagccatcagatgtttgaaaaaaaattttaagcatgaagcaaagagtctagttttaagaacttagctgtgaatggatgatatcctacccatttaatagagttctccaaatgaacagaaagtatacaatgaaaggaaggtcccttagacatttgaagtttttctgcagcacaatcctgtctgtctgctttattcaagaatttgtagtcattttcagaattcattccagaaaccagcttattcgtttagatatcagcacactggtcttggcaaaagataacacaaaagtaaacactactatgtcaaaaaggatgaaaagccagcgatccaaccagtagaattgttttggaagctgtttgtctcggactgagatcacacattaagccttggctgttgccttccattcttgcacaagcctccctgctcctggggaccctctgtaagagtgagcgtcctaatgaaaatagatggcacactcaaatggctaaagtagggagagtttatgaaggaatgatttataaaagagtgggaagtgttaagagaacatggtatgagtatctgatgagcaacagcagatagccgttatcacctttagacatacaagggcagaatagggagctgttaagactcagagagtagctgtatagagattcatttgaaagaagccgtggctctggtagtagaggagcatcactaaccagaggtgattttacatgagagcaggggtggaggtgggtgggagagtgggggagaataactaccccaggctcacttcctgtctttctgtcttctgctcttgtattccattggttgactccaccccaaagacagagggcaaggggggctttggatataaacaagagtctcctggggcactgaacagggtggaggagaatgaagaatggatctggaggggcaaatgaaatattcgtaacactacctttttttaaattatacttttaagttctagggtacaagtgcacaacgtgcaggtttgttacatatgtatacatgtgccatgttgggtgtgctgcacgcattaactcgtcatttacattaagtattcctcatgctatccctcccccctcccctcaccccacgacaggccccattgtgtgatgttccccaccctgtgtccaagtgttctcactatccaattcccacctatgagtgagaatatgcggtgtttggttttctgtccttgcgatagcactaccatttttttaaggacacagtatctgcagtatcggaggaaggtccttttaggaagaatcatgtaaacaaagggtagaggagtattgaaataaagagtatgttgagaaaatggaaaatatttcagatagtttggagtgtgtgcttaagaagaataggcataaaaatgaaagcataggttagtatttgtagacaaatgttaatctttatattgcatatcctcttatttattactaagtcttgtattataaatgtttttataaatacctgagaatcaatagtgccttcatcattaggtgggagatagttggtcgagttttgtgccttagcatagttatctgggtgatttacacatagcggcttagtgcaaatagtacaaagatcagaagtcatttagagagtggggctttcagttaagaatataggctctggatttgcaccatctgtgtttaatttctgactccagcactttccagcttgatgaccttaggcaagttatctaataccggctcagttttctcattttcaaaataggtacagtcataatagttttattttagagtagttgtgaggattgagtaattcacatatttagcccagagcctagcagatactgttaataaatgttacctattttttgttttttagtttaggagggtattataggtatctttgaatatttgaaaggctgccccatgaaatagggattaaacttgtcttcatgagaacctccagtatcagaatcaggagtaatgtgtataagtaacaggcaaacagatttgggattaatacgagaaaatcttttaatagttatagagttgcttgaattagaataggttagctcatgagataatgatttacataccaagggaagttttcaggaaaacatcaaggggatgttttaaagtattaatgtctcaaaatgagaaaattagataaaagctttaggatatcttccaaccataatagtctattactttatcctaaaaaatttgtgaaaatcaaattttacgtaagaggaaatgtgtttgatttccttttccacatctctgtctgttcctgttgacaatttctgttcctaactaccttccaacaatccagcttacatgtcatctatctttgtttaatgatacgtataatttttttttttttcaagagacagagtctcaccatgttccccagactgggcgcaaactcctgggtaggtaatactcttgcatcagtctcctgagcagttggtactacaagtgcacaccaccatgcccagcatatttaacaatatttattgagcacatacaaatgtgccaggtattgcgctggatactgtgattagtacagtgaacaagacacatcagtctcctgccctaatggagctttaagaaattttagcagagggaaatagaaagtaaaaacacagtgaaataaatttcaggtagttttaagtactgtgatgcatgaagaaaataaaacagaataatagtataaagggatactagggctttggatggtggaggtgaagatggtgctttaggtatggtaggaagggaaagcctctctgaagaggtgacattttaaccagcatataaatgttgagaaggagctggttgtgctgagggaagcacactctaggcagaagaaccagcaaaggccctgtggtgggaaagatcttgacatgcttgttagaaagcaaactgggtggctagagagtggtgggagtggtaagaacagtgtggatcacataaggccttatacaccttgttaacatttacatttcactccaattgcattctaatggcaagtcatgagacaattttatggtataatttatgtttaaaaaagattattcttgcttgtttatgggctattgacggaatagctagagtggaagcaggaagataggaggctgttggagttatccaagtgagacataatagtgacttggactatctcagatgactttctcccccatttatccctggatagaatgtcctttaaaaaatattttataggccaggcatggtggctcatccctgtaatcctagctctttgggaggccgagatgggaggattgcatgaggccaggagtttgagaccagtttgggcaacatagcaagactctgtttttacaaataattaaaaaattagccaggcatggtagtgtgtgcctgtgttcctagctacttagggggctgaggtgggaggctaggaatttgaggctgcagtgagctgtgattgtggtactgtactccagcctgggtgacagagtgagaccttgtcttgaaaaaaaaaaaatatatatatatatatacatatatatatgtatatatatattttatagtgtttaccagatactagtgttaaagtatctttatattatattttaattaggtatacaattggctttctcattagattctgagtttcttaagcacaaggacaatgtcttatcccttttcttattattttaggtagcattatagcactgttattaattttgcacttaatgcattgctattaagtgaattcatgaaacttctatctgaacacagggctttttatagctattacaaatggcacagttaaatacgtaagtgcaataaggtaagctagatttgagatggaattaaaaaaatactttcccatactttacacacagaatgtagtttgtatacagtttaggaaaacctactaagaagggaaaatcacaatgttttattaggggtgaaacacaaatcagaaaggcttagggaaataaaaccaagaactagttttgttggtctatttgttatgataaaggctaaactaatgttaacaagagacaaatatagtggctcaagtaagaaagaagtttatttatcatataacaacaggtcacacattcaggctgctgggtctttcacgggctccttcctttatgttgctctgccacctcttagggtcttgtcttaatctgcacggtcaagctaggacattgtcacacttatcttccagtcagtggggaaggggaaagagagagtccacagagtccagataaataattttattttaaacaagtgaggtgaaagttgcatgtatcatcttgctcatattccactggtacttagtcatatggtcttactcagctactagagagatggagaaatgtagtttttagctggggagtcatagcaaaaactttactttttttttttttttgaaatttaaagaaaaaatctattgaagatctgaaaaacaattcctaaaagatagacttttccagaaaacactagctacacaatgtattgtgtctatcatgttaaaacatgcattagacacaaatacaaaaaccatgaaacaagccaccattcttcaacaatttgagcaaagataaaatgcctaagtaacaacatggatgacttgcaaaggatgggctctttactttaagcaccataaaaaaaaaaagcacaaatggatgagtgtgttcagttatatacactgaattgaacctttggcactaggaatcagagtattttgtcatatagcattaacatgtattataaaagtgcgtagtgtcaaaggaatagaaccaccaacattcaaaagcagctttgtcaactaggcagtaaaacactctacagcatatcctctgttgtccatcattgaatacactggtagtgactttgaaattaaaaaaaaaaagaaaaaggatctattaccccttttattttctttgtttaaaacaaaacagaaaaaaacatcagttgttacacactaacatcttcaaagcacatcgtttgtacaagagatagactaagaacaaaaatgtgtttacagagatccaaacataagtgagtgagagcgcctctcacatggctctcaggacggttctcaggaggagccacttcataatctctggcactaaacaaagttgtagaattctttgccaggtacttcaggaaatcatgaagataattcagtaattaagcaaggctcttctcatccagaggtgtataggccaacattgctccaattcgtacaagtaatctcaggagatgtggcactccatacacctgggacatgggtgccttggggtgatctgcaagaatttcggcatactgtggtctctcaaatttgtagagtagttgggtgcccaacattacgttgaagtattcttttatccctgccacaacttcattaaccgcatactccttattatctgtgtttccaccagatttcttgtaatttgcgtaatcctcaagaatggaatccacatttcttcttggcaggaagttaaaagagctgttttcgtctggtaattaagtcccagtcatcaacaagccacagttttagctcttcaggaagctttactttaacttcaactctgttcatgaatgtttcctcattttcaacagtaggatctacccgggtccttttcttccgaggaggccaaggagtctcactggtactgccaccatctccatttccaggggttttctgtttgttcttttttgttttcacttcaacatttttctgttggagaccagatgtcttctttcctggggcagcccctatcgtcttcccctctgcatactgctcctgattggctttttgaagttcttattctttctgcaaattagtgtccttgtatttgagtactctgctctctggaacccactcatcccaatttttattccaaccactgtaatgtataaagtatttcacttgtttgtccttaatggcaacctttacacactttgtttcatgaagaagaggcccatgaaagcacagcactcactcaacctcctggaatttaggctttgggtcctgttttgaagccatttataagtgatttgctgtctcctccttctcctaccacccccaactaaaactttactaactttgattttcagctaacaatcttctaaagttgctgttatttgaactacttaaagtgaatatgagggtaacaactaattaatttctgcttcttaccctcataggaaaaatattgaacttctatgtagcacttacacttagggagagacatcttgatcctgattgcaactgggatggaaaactgattttattactattctaagaaaagtttttatttgtatttttattaaaaatgaagttatgttcaaatgaaagagagtatgtatgagtcttgaaaattgttactttaggtaaggcaggactactaatttttttattatttttataaagaaacaactcttgctcaccaaagggcttgtagaaatggtgggctggttgccctcatggcaggtataaaggatacggatgtataatatttctattaaggcagtttgggataagggattacttattgcttttaatgtatatcttccttgttatcacatattaggttgatataattcttcatcaggtagaactgaagttctcagagttggagttgaggatgaaaagctgctttagaaccttttaggccttaagtcagtgtttctgttttcaggactgtctcctaaagagaggtaacttttttttctgttggatggtaaattatcacctatttctctatttcttaagagcagacataatctttggggtcgttcctttataatcttgattcagtattttttctttcttatcaatattgttattcattttattttttgcttatttaaaaaaaattcagataatttacatataataaaatgcatgggcctaaatgttgagttgaagttttgatggttatatacacttatgtaatcatgaaccaaaacaagatacagaatctttccttgaacttctttccggtctgttccatccagctcctcagagacagccacttactgatttctattgccatgtatttgttttaactgttttttaacctctttaaataaaattatacagtatgcattcttttgtgttgagcatctttcacttcatatactgtcctgtaatgcattcatattgttttgtatatcagtcgtgaatatattcaatgaatatgttccctgaatgaatatattttatgaatacatcacaatttatttattattctgtcacaatttgtttatacattcttatgttgatgaatatttaggtttccagtttttgccttatgaattaggctgctctgagcattcttgtgcaagtcttttttgtggagacatgtattcatttctgttgggtaaatacctaagagtgaaattaagtcagagtagatgtgtatttaacattaaaagaaactgacatacactttttcaaagtggttgtaccatttacactcctaccagcaatatatgagagttccagttgccctacatcctcactaacatttgatgttgccattcttttattttagccatatagtacctgtgatgttgaatgcctttttatgttcttattgaccatttatgtatcttcttttgtgaaatgttcaagtcttttgctaattttaaaattggattgttcattttcaaaaaattactggtttgtagttgttttagacagtcatgcgttgcttaacagtgaggatatgttctgagaaatgtgttaggtgatttcgtcattgtgcaaacatcacagagtacttacacaaacctagatgttacagcctactccacacctaggctatatgttatagcctattgcttctaagatacaaacctgtacagcatgttactgtactgaatgctgtaggcagttgtaacacaatgctaagtatttgtatatctaagcatatttaaacatagaaaaagtacggtaaaaatatgtacacctgtatagggcacttaccatgaatggagcttgcaggactggaaattgcatttggtaagtcagtgagtgagaggtgagtgaatggaaggtctaggacattactgtacactattatggactttataaacactgaacacttaggctttttagttttccaattactttataaaaaagtaaccgcgtcacaatgtcatgacagctgcaactgaaagttcattatgtggcatgtcactatattatggatgtgagtcctttgccatatgtatgtgttatgaatattttctctcaatctgttgcttacctcttcattttccaaatgtctttggataagcagacattttaattttgtttaagtctaatgcactaatttttttcctttacatttagtgctttttttataccttaagaaatttttgcttaagcatctctaaggtactctgttttcttctagaagttttatggtgtatgatctaacttgaagtaattttttgggtatgaggtaaggtagggggtcaaagtttgctttttccatgtagataaccagttgttccagcactgttttgttgaaaagacttgacacccttgtctaaaataaattggtagtatatttgttggcttacatataggaagctagccttagtttttaattttttttctgatttaaattctaaaaaaaatgaaaaccagggatagaacctataatgggtaagatggcacttatcttgttgtattttagagttttctggtggtgtcattttcagaatacattttgtgttcctcagaataaaggaaatgaagcttatttcttttattctcaagccaaatcactctctgaggattgaggaagtaatccagggtttgatatggggctcatggcataaggttaggtagcctgttatctttaactttctagattacttcataaaaataacttgcgtatatgtaatgatatctttctatgttttagatgttgttcaaagcactgaattgtaaacatattctcaatatttccctcgaatcttaagtatttaccttttattttttttaatttaaaataaaaaattaacagagtaaaatagatgttttttggtgtatggttctatgaattttaccatgagtatagattttgtatatccactacaacattcaggacatagagttgtcccattacttccagaagttcccttgtgctttctatccctttgtagttatatcttccttctatccctaatccctggtaactactagtctcttttccttcactgtagttttatcttcttgatgtcataagtgaaatcacacagcatgtaaccttttgagactggctacttttatttagcataatgcctttgagattcatccgagttgttgcatgaaccagtttatattttattgttaagtagtagtccattgattggatgtacctgtttatccattcattcatcctttttatttggggggacagagttttggtctgttgcccaggcttgagtgagtgcggtgacacgatctcggctcactgcaacctccgcctcccaggttcaagtgattctcatgccacagcctccggagtagctgggattacaggcatgcaccaccacgcctggctgatttttgtatttttagtagagatggggctttgccatgttggctaggctggttttgaactggcctcaagttattcacttgtcttagcctcccggactgctgggattataggcatgagccactgcacctggcctatccattcattctttgaagaatatttaggttttttttttctagttgtgttgattaggaatagaactgctgtaaacattcacgtacaagtttttgtgtgaacattagtttttattcctctagtgtaatacctgagagtgggattgctgggtcatttgttaagtgtatgtttaactttataagaaattgccactgttttccagagtgtttatgccattttgcagttttactggcagtgtatgaaaattctagtagttccacatcctgaccagcacttggtattgttagtatttttaatttttgtcattctaggtgtgtagtggtattgcatcatgatttaaatttgcatttcgttaatgggtaatgattttgagcatctgttttttatgggtttatttacattatatatcatctttggttaagtggatataagtcttttgttggatttgtgatttgcaaatattttcttccagtttgtagcttgtttcttcattctatgaacaatgtctttcagagaaccgaagattttaattgtaatgaagttcagtttttcaattttttgttttataagttcttttgatgtaatatttaagaactttttaaccacaggacatgtatattttttcttatgttttcttataaatcttataaaaatttagtagctttatgttttaccttaagacctgtgatgcattttgagttgatttttgtataaagtgttaagtttaggtttattttctcctacatacagaatttccaattctaacatcatttgttgtgtactctcctttgtttatcgaatggctttggcacctttgtcaagaattaatttgctatatttatgcagatttatttccgggttattgattctgtcacattgatcaatgtgtcattccctctgccaataccacactgtcttgattactagaaaattgtgtagtgtgaatcttcttatcttttttttttcaatattgtttgacctttgcagaaacattttagaatcagcttgtttatatctatgaaaaatttggctgggatttccattataatcacattaaattagtagaatcaatttgggtagaattgacattttttaggctcttgagcccctatgtgtgggcccactcccactctgtggagtgtactttcattttcaataaatctccacctttgttgcttcattcttttcttgctttgtttgtgcattttgtccaattctttgttcaagacaccaagaacctagacgccctccaccggtaacatattttggcaagccagccaggatgtaaaataagtttgggatttatttttttccttttcctttctgctccacgcagtggaatctcttcttcactcgggacccttggtgggcagcgcctaaacacagaggcaactgcagatttctggctgggatcactctgaaggactctcttctgtcttttctgcttgtggttcctgatccctacatgtggagcagctcagggcgaactcacatgtgtttcaggcaacttaaatcttcttttcttacactaaatttttcccttactctactcgactggctaaggacaaaagaaacccacctagcctccagttcctatcactacagttcacggaatggagcaaagtccactttgctccatcactctagtggaacaggaagcatgctgttccactagagtgggaccaaatgctcctcctttgctccatcactgtagtggaccaggaagcatgggaaaagatggccttatcaaattttaaggattctgaaagtcagggattatacctaggaaccaaagggaagctcatagtagtaggccattgcctctggagggaaaacatgcaaagcggcactggtgcccacgtaacgtcagagacgtctgatactcttaagactggaccccaaagagggatgccccaggggatcctttggacctcaacctctctgaagggaacacccttggcagaggtcctaaggcctagtactaagccctccttagaattttatctcacagttgcaatactgtttggccccagtattgtttggaatcaagtgtgttgttgaatgggaaagtgagatggagttgcatgtatccaggctttgatgctgctgttccaagcagggtcaggcctggttatatgtgatgttctcctttggtgctgtttggccccagtgttctttggagtctggggaggtttgacctttacaaattaaactgccatggaaactgctttacctgaaattttggttcactgccttcattggattaactactggggcaaacaaaagtagaaccggcaagtttgtattgctgtctcatggctagagttccaaggtaaaagctattgaatcttcatttgtatgtgtatatacatgtctagatgtgtttatttgtatgtacacttattgttatacattctgtctacaaaactgacatacacgtaaaagagtactcataaataagtctaagtacttttcaagttcatgtgacttaagtataactttactaaacaagctggttttaaaatgattggtaaaataaaaatagaaatgacttcaaaaaaaaaaaaggaatggacattttttactgttgagtcttccaatccatggacatgatatatctctttatttacttaggtcttctttgattttattcatcagtgtttcgtaatttttagcatataaaccctgttgactttttgtttgatttacatgtaagtacagatcctcctcaacttatgatgatggggttatgtatccagataaacccatcgtaagttgaaaatattgtaagccaaaaacatatttttggcttacagtattctcaccagtcaaaaccagactttcaatttatggtattttcaccagtgaaaagcacacttttgacttaatattttcaaaccagtgaaaagcacatttttgacttaatatttttatcagttgaaagcacactttcaaattgtgatattttcaacttatagtgcatttatctagacataacctcattgtaagtcgaggagcatactgaatgtatattgcttttgtaccactgtgatacggtttggctgtgttcccacccaaatctcatcttgaatggtggctcccacaattcccatgtgtcattacttccagtgggaagtaattgaattgtgggggagggtctttcctgtgctgttctcgtgatagtgaataagtctcatgagatctgatggttttgtaagggagagtttccctgtacaaattctctcttgccatgagtgtgaggacttccctgccatgtggaactgtgagtcaattaaacctctttcctttataaattacccagtctcaggtatgtctttattagcagcgtgagaacagactaatatacattgtaaagctgaaaaattgtaagttgtaccatcataggttgaggactgtctgtatttatttcttagagctgttgtaaatggtatttaacaagaattggtttccagttgctctttgctagtatatagaaatacaattgagttttgtgtgttggctttgtattctgtgatgttgctgaattcacttattagttctagaagcatttttcatagagttcttgagatttttctatgtacagttgacccttgaataatgcagcaaggtggaagttaggggtgctgacccctgaagcagttgaaaatctacaaataacttttgactcccccaaacctaactactgatagcctgctgttgactggaagccttaccatcaacataaacagtcaattagcacatatttttatgttatatatgttatatactatattcttacaataaagtaagctagagaaaagaaaatgttattaagagaatcacaaggaagagaaaatatgtttactgtttaattcatggaagtggattatcataaaggtcttcatcctcactgtcttcacattgagtaggttggggaggcggaggaagaggaacagttagtctgtctcaggggtggcagaggcagaggaaaatccacatataagtggacctgtgcagttcaaacctgtgttcaagggtcgactgtaaatgataacgttgtctgtcaataggacagtttgatttctttctttctaatctgtatactttttatttgttattttcctgctttattgtactggctaggacttccagtaccatgatgaataagagagatgtgatattatattttttccttggttccaatctaggaaaccattaaatatgatgttggctgtagttttgtttaaatgccctttattatgttggggaggttcctttcagttcttagtttgctgagagtttttatcatgaatgaatgttgaatgctgtcaaatgcctttttttgcatcaatatgatcatgtgggtttgtttttaaactgttaatatgatggattatattggtcaatttaaaaaatattgaacagctttgcattcctagtataaatcccacttgattgtgatatattcttatacattgctggatttgatttgttgatattttattaaggatttttgttgttgctatgttcatgagggacataggcctgtagttttttgttgttttttttttaataccttttttggtattggggtaatggtgactctcaaaacgaattgggaagttttccctcctctattttcagaaatgagtgtatagacctggttttatttcttcttttttaaatatttttcttttattgatacatagtattgattttttttttttttgagacggagtttggctcttgttgtccaggctggagtgcaatggcatgatctcagctcaccacaacctccgcctcccaggttcaagtgattctcctgcctcagcctcccaagtagctgggattacaggcatgcgccacaacgcctggctaatttttttctgtttttagtagagacagggtttctccatgttgatcaggctggtcttgaactcctgacctcaggtgatccgcctgccttggcctcccagagtgctgggattacaggcgtgagccaccgtgcctggcctgatttttttcttttaatgttgggttgaatttgctagtgaaaccatctgggtctcaattttttttttctttttgtttttttggaaagctttaaactatgtgttgaacttatttaatagttatagaattactcagaatatctatctcatcattggtgagctttggtagtttgaatttttcaagtaatcgattcatttcatctaagttactgaatttatgtgtaaagtgttatttgtagtgttattttattatccttttaatatctatggagtctataatgatattcctcttttattcttgttattggtaatttatgtctatctttttttctttatcagttttgtttgaggtttataaatttttaaatcttttcaaagaacaagatttggtttcattaattttctctattatttttctgttatcactcttattgatggggagctgatcattatttcttttttttctgcttgctttaggtttattttgttcttcttttcctaatttgttaagataaaagcttagatgattgattttagagttttattcttttctaatataagcattagcttctttgagtttccctctaagcactatgctagctgtgtgccataaattttgatacattgcattttagtttttatttggttcagactatcttctaatttctcattaaacttcctctttgaatgctggcttatttagaagttatttaatttctagtgtttggagtatttctgccatctttttgttacctatttctggttcaatttcattatgatcagagaacatactttgtatgatttcaattctctgcatatatttgatgtctagatatgagattttatctgtggtacttatcctggatagatttactaggttgtagattatgtcagtcttcagttttgctagaaaatgccaaattgtttttcaaagtttgaaagtatcaggggaacccaccccccgtatttcaacgtaggttctttatattttctgtaagtgtcggccagttgagaaataaagagaaagtacaaagagaggaattttacagctgggcctctggggatgacatcacgtatcggtaggaccatgatgcctacctgagccttaaagccagcaggttgtattaagatttcaaaaggagagggggtacaagaacagggagtaggtcacaagatcacatgcttcaaagggcaaaaaggagaacaaagatcacatgcttctgaggaaacagtacaagggcaaattcagaactactgattagggtctttgttcagctgtgcacgtattatcttgataaacatcttaaacaacagaaaacagggttgaagagcagagaactggtctgacctcaaattcaccagggtggggtttttccccaccctagtaagcctgagggtactgtagggaaccagggcatatttcagtccttatctcaaccgcataagacacttgcagagcagcgtttatagacctccccccagggatgcattcctttcccagagtcttcattattaatattccttgctaggaaaataatttagtgatatcttccctacttgcacatctgtttataggctctctgcaggaagaaaaatatggctctattctgcctgaacttgcaggcagtcagaccttatggttgtcttcccatgttccctaaaattgctgttactctgtttttttttcaaggtgcactgatttcatactgttcaaacacacatgttttataatcaatttgtacagttaacacaatagtggtcctgaggtgacgtacatcctcagcttacgaagatgacaggattaagagattaaagtaagacaggcataagaaattataaaagtattaattttgggaactgataaatgtccatattaaaatgaaatcttcacaatttatgttcagagattgcagtaaagacaggcgtaagaaattataaaagtattaattttgggaactgatatatgtccatattaaaatgaaatcttcacaatttatgttcctctgccgcagctccagccggtccctccgttcagtgtccctgacttcccgcaacatgaaagtagttgtacgaatctattgcaccactccccctgccccagaatgggatatgaatgttctatatcctccctaaacctactatgtatttgatttattcattattctagtcttggaagacaattaatcactaagggaacatttttctcatctttttttttttttttttttttttttttaagacagagtcttgctctgttacctgggctggagtgcagtggcacaatctcggctccctgaaacctccatctcctgggttcaagtgctttttctccctcagcttcccaagtagctgggattacagacgtgcaccaccatgcctggctaatttttgtatttttagtagagacagggtttcaccatgttggctaggctggtcttgaactcctgacctcaggtgatccacgcgccttgacctcccaaagtgctaggattacaggcatgagccactgcacctggcctcatctttcgtgagttaagttttatatcatccttgataatttagggtatcacagtaagcatactgaagttgaaaactcaagtaggttttggttatcattccaaacgacttgaagtttctcattggtcatggagttttggctgtgaaacaggacctggggctgcctctagccagagtgattctacctatgccacaggtggacaggtaagcccttttatggttgctgaaataagtccatatcctagagatgagattagattttcaccaatatctacttccagtcttcatgctttaaatgttgaagttcttcagttttgtacaggtaaaagaaattcttcacctaattctaagtttttacctaacttcttcaaccagtcttttcattgcctgatggaattctgcctgggttttaaattcttttaaatttaaaaatttttttacgttcttcctatctgacaaagacacaagtcttccattcgaattctacaaatctcttatacctttatctgagtctatattttcaacccttatgtgctaatgacaaatatttaattccatccttaaaggatagttgattgtgggcatctactgtatttcataacctttgtaatacaagttatataatttttagtgcttaaactatactttaaagaaaataataacagtgattagtagaacttagccttgaattaatttgagactgttgaaatagtggtgaacttttaagacgcagaggaaagtttttcctttggggataagttattttaacctgagacattttaaatgacaggaaaacatctagctttctttttttatgagtgattaaaatttaaagaggaaagtaaagactgaattggctttatacttactttaaattttaaattaccttaccatctatttaacttaaaaataagccacttttattattcagttaacaaactgaatatcattctttgtttttatttttattttttttaaagacagagtctcgctgtgtcgcccaagctggagtgcagtggcatgatcttagctcactgcaagctctgcctcctgggttcatgccattctcctgtctcagcatccctagtagctgggactacaggcgcccgccaccatggctggctaattttttgtatttttattagagacggtgtttcaccgtgttagccaggatggtctggatctcctgaccttgtgatccacctgcctcggccttccaaagtgctgggattacaggcgtgagccaccacgcctggccattcttttattaaaatattttttatagtaaaaatgcaggtgtattatgttatatttattcgttttggtaatatggttttattaaacttgacgaaaatgccttccaactatccatgtgttactcagaggtatgagaatgaattagccgaacaatttgaacaaaagttaagataatagacatttagaatgcttcttgctagaatgaagttctgatttgtgaagaatattactttatcaggtagggaagatatataaaggcagaaaaattattaaattgtgacttcctaaatgtctacttaaaaacatttatggtaaatttataatgttatattgaattgatttgaattatttgaatcttaaaatatagtgtgggagcttttttctaaagtatatattattaaaagctgagaaatatttaagtggttgaaagccagtgggaaatatgaagcaaactgctaatgcaactggggagacaatagaactatgtttatttaatattaagcattaaacttatgaagattttactggaaatttgattggtttttctgtcacccaagggtattttaagcctgttttatgcattatacctgggctgtaccaagagcagatggcaagttcccaggggaactttccaactgacccataatttgagataagatgatagtttacagagctacaaaaatagtcttggggtttgccactgtttttgttttagttgcctatcagatcttttgtcaccttttctctcacagatcatatggatgacatacagttctgtttatttgtcaatatctaattgattagcataaagttataagattataattcaagaggtgaaatggatgctaattggaactcctattaggaatttgctcatcaacatacaatttctttttttgaataatcaaaatatatacttttcattatatagattcagaaaggttctgaaaacataggagatattttcttttaaagctgcactcagaattttatttctgtgatactcaggtgaaagtatgtagtttcccttttcatttaattttattaaaattgaattaaaattttctttctttttctttctttctttctctctctctctctttctctctctctctctctctctctctctctccctccctccctccatccctctctctctctctccctctccccctctccctcttctctctctcggagagaacatgagtattttcaggaaattagagatttgaatttgaaatattttttgtatatcaagaaatccatcaatctttgtttaactatggaatcttcagaacatcagagttgcatgtttttaagcttagagaaaaatggacacactgaatcttagcaactgaaagcaaatagacatacgtcagtatctgtgtatagtgctgacacttatgtcagcactttatcctatttgcttgggaactcttgtttagtagtgtgtttacaatgaggcctttcagtggagagggctacatgactgaatgtgtgtgtactctgtattgtctgagtacattctatgtgtaaactttaagatatgtttatagacatatttgttattgacatttagtcttgtatttattttatttctcagaagtattttatttgttcatttttgataactagcactcagccattcactttttatttctaattttggtgtctttgtgtaggtcactgagtgtgattccagataagttattacagctagatctatgtggctcatcagccacatatttggtttttttgttgttgttgttgtttgtttgttttgagacagtcttctctgtcacctaggctgcagtgcagtggcatgatcttggctcactgcaacctctgcctcctgggttcacgcgattcttctgccttagcctccccagtagctgagattataggtgcccaccaccatgcctggctaatttttgtatttttagtagaggtgaagtttcgccatgctggccaggctggtctcgaactcctgacctcaggtgatccaccatcctcggcctcccaaagtgctgggattacaggcctgagccactgtatgcgtcccacatatttgttttagagagggaagttcgtgcaattaaaggtggaataatctggatttgtcataagtcctatgatttcattgtgctttagttttctgaacagatacgatgaaaattatctactaagagtttaaaatatatcgctgagggttaaaataaagttcaaagtactcccaagtattatgggaatttgtctgtttcttgggaagcagggtagacgttatctaggtggaaaagacgagtgggcaatttgaaatgttagactaggagcttggaaagagagaataaggctagagttatactctagaagttactcagtatattttattgaaggcctaatatatgtcctttaagattgaagccctggaattcatgcagaccacaagactagcatctcctttgcttgtggaattgatagtctagttactagattctagagggaggattatttgctttgaaggtcataggtgaagcttgggaatggatgagactgaaaaaaaagagtgtagatatgattaaaacaattaaggacacagtgactttgggaaatacattatgtaggtttttaggagaaagacaaggactgtgggggaagtacctatgtttggtgattggcatgatgaagagtcagtgaagaaaagaggttcagagtgtcagggatttgggggatttatcattaagctaattaaatttaagctccaggtttgtcacttacataaaatcctttcaagtctgtaggaggaaggttttcacatgggcatatgtttctgtaggatttccaaaagtaaggcatttcaatattgccatttctttcattctgacttaccctcatgtcatatggcattagagtggctgcaggcatttttgggatccagctaaggggaagttgaataggatttacatttagtttgggaggcatgtatttatgtggtcatgtcacttctgaatatagactagctgttctggtataggaaggatatcaaggaatactggtgttactcactgtgttaacacttagtgttatgacacaaagatggaaggctagagatcacctggtgatatggacgtgtcctataatgcatcacattagaagtacgtggtaggataagagaaacaaaatttgaaatacacggggccagaagctagtctgggaaaaattcttccaaatcgaatggtttataaatgaaagaaaatatatgagtttctctaaatttgacaatactaaaagtttatgacattaccagtagtagtttgtgaacagtttgtgaagactattttgtaaaatataaataacaatttagtcttttgaaaattaaaaagatatttatagaaaaccttacatataattgccatatgaagaggtgataacaaaagttatgcaaaaaatatgtagaagtatactagaagtgtgtcagggagtttattgataacattattgttattttttctggattcttgtgatgtttatgatgctgtgacttttttttctcattctcagtaagtattcacctttgtatctaattttgtatttgtaattttgcttccttttttttttttttttaaagaaggccccctaaattctagaaggttcaggcccaacaatacctgggaggcacagaatcatggaagttaagaggagacaaatcacggatggagaatatgtactcttttaaatgatgcattggggtagctaaggaaggcagttgcatttggcaattcagggattattgataatcttcactaatgagtatgaatttgggagtgggaagtggaggttgtgtactttttaaagaaagtggcagtagagtccaagaacagtagcttttgaggaaagcaaggtccagggaagtttttttgtatgtgtgcatgcttcaaaggtaggtggacatctaaatacgttaaaggaagggaaaacatgcaaatagcacagaaggaaaaattaaaggcaatagcaagagaggttaaagcagtgtagaaatagtgacgagagcagggaggaaaaaggaaatgaggtcaagacataggagtgttctaaatagtagaattcagtaaaggtgatttaattgttactgtattagcactgtgctagtgctgagtgcaataattgattttcataatgctgtaatttttctgcaaatcaacattttatgcttagttcattaagatttattatacaatttataaagacttacaatcacataatttataaagattttcatttggatgtttaaaatgaaatgtttcatgacatagttggaagataattatcttaattatctaattagttgaatatgttaaaattaatcttccagaattttttgacttattaagtgattgccccaaatcagcttagagatattatcaagtattttgctagtaagttatgtaaactaattaatagaaaatacatgaaataatcttattttctcttagttttatagatggtatggaaaaaggtacagaattgtcaggtaggatatttattattattttttccatttaactcatcaaaatgtattgaatgtttattatatgccaggagcaggtctaggtgctggagatagagcagtgaacaacacaaaatttctgccttcatggaatttacattttagtggaagagacagaatataagcaaataagcatgtacgtatatattgtcagatagtaatgtgtgttacaaagaaaaataagggagagtaaggcgacagagagttgtataggatgatatttcagatagtgtggtaaggaaagccaggtaggacacttatatgttgctttttgtcagtgtatttagaaaactattttatgcaagtcaaattgtgtttactaagatcaaatcatttacaatttaataggagcaacatctgcttacctgagttttcccttctgaaattattgatttataatagtaccaggctaggtgtggtggctcatgcctgtaatcccagtactttgggaggctgaggtgggagaattgcttgggtgcaggagtttgagaccagcctgggcaagatgctgagacccccatctctacaaaaataaataattaaaaatcagccaggcatggtggcatgtatctgtagtcccaactacttgagaggctgaggcaggaggatcctttgagcccaggaatttgaggctgcagtaagctatgaccatgccattgcactccagcctgggtgacaaagcaagaccctatctctaaaaatgatatatataataataatagtatctacaccataggtttgttgcatggtttaaataagattttgtatgactgttttggtgcagtgctcttactcttcactttatatgaagtatgcctgtaaaagggaataaaacttagtatgtttcgcagatactgtgtttttcacaaattggaggtttgtggcagcgctgtgttgagcaagtctgttggcaccatttttcttacagcatatgctcactttgtatcttcgtatcacattttggtaattcttgcgaaaaatttttaattttttattagtatatctattatgactatttgtgatcagcgatctttgatgttactactgtaattgttttggggcaacacgaatcactgcacccagagaagagagctaacttaattgataaatgtgtgggttctgactgctctaccagctggctcttcccctatctttctcccctgtccttggacctccctattccctgagacactgcaataatgaaaatgggccgattaataatcctacagtggcctctcagtgctcaagagaaagcaatagttgcacatttcttaccttaaatagaaagccagaatgattggaccttagtgaggaaggcatgtggaaagctgacatacaccaaaatgctaggcttcttgagccaaacagttagtcaagctgtgaatgcaaaggaaaagttcttgaaggaaattaaaagcgcttctccagtgaacacaaaaatggaagtgaccagctttactgctgatacggagaagttcgagtggtctggatagaaaatcaaaccagtcagaacatttccttaaaccaaagcctatcccagatccaggccctaactctcttcaattctgtgaaggctgagagaagtaaggaagctgcaggagaaaagtttgaagctagcggaggttagttcatgaggttttagcaactatctccataacataaaagtgcaaggtgaagcagcaagtgctgatggagaagctgcagcaagttatctagaacatctagctaaggtaagtggaaggtggctgcactaaacaacagattttcaacgtaggtaaatcagccttctattggaagaagatgctaggactttctagctagagagaagaggtcaatgcctggtttcaaagctttgaagcctaggctgactgtcttgttagagactaatgcagctgataactttaagttgatgccagtgctcatttcccattctgaaaatcctagggcccttaagaattatggtaaatctactctacttgagccctgtaagcagaacaacaaagcctagatgacagcacatctgttggtagcatagtttactgaatattttaagtccactgttgagatctactgctcaaaaaaatatattcctttcaaaatattactgctcattgacagtgcagctagtcgtcgtccaagagctctgatggagatgtacaaggagataaatgttgttttcatgcctgcaaacataacatccattctgcagcccatggatcaaggagtaattttgactttcaaatcttattatttcagaattacatcttataaggctatagctgccatagattgatggatgtgtgcaaagtaattgaaaaacctggaaaggattgaccattctagatgcccttaagaacatttgtgattcatgggaggagatcagaatattgacattaacaggaatttggaagaagttgattccagccctcatgagtgactttgaggggttcaagatgttagtggaggaagtaactgcagatgtgatggaaatagcaagggaataaatagagcctgaagatgtgactgaattacttcagtgtcatgaaaaaacttgaacatatgagtagttactttttatggatgagcaaagaaagtggattcttgagatggaatctacttctgataaagatgctgtgaacattgttgaaatgacaacaatgggtttacataaacttagtggataaagcagtggcagcatttgagaaaattgactccaattttaaaagaagttctagtatggataaaatgaagcattggatgctccagagaagttcttcccgaaaggaagagtcaattgatgtggcacacttcactgttgtcttgttttaagaaattgccacaggccaccctgccttcagcaaccaccaccctgataagtcagcagccatcagtattgaggcaagacctcccaccagcaaaagaactacagtttgctgaaggcttagatgatcattaacattttttagcaatagagtatttttagattaaggtatgtacattgttctttaagacataatgctacttagcactttactacagtatagtgtaaatatacttacagtatagtgtaaatatactttttatgcactgggaaaccaaaaaattcatgtgacatgctttattctgatactcactttatttcagtggtccagaaccacatttacagtatctccaaggtatgcttgcatttcttgtctgcttttatgtgaaccaaataagttataatcctctattaaatacctttcttttctgtagatacctccaaattacagaatgaagcttctgtgttttttcaacttggagattaaataatggttttaaattgaggcacatgcatatactgtaaggtatattagtctcagatatactactcagtgaatattttcttagatacatacctatatagtcgccacacagatccaagtatgccgtattcccagcacaccagaagaaatctttgttcaccctttgagtcattactaccttctgtaggtatccactgttctgacttccatttccatcaatttgttttctcgtttttcaatttcatatttctgacttctatttccatttctattttatgaaaattcaaaaaaggcaaaacaattttatttatttatggtttgttatcttttttatctggcttcatttgctgaaaacaactcctacaaaattcatccacattgttacgttatcaccagtttgttgggtttcagttctgtgtagtgttccatagtttgaatggaccacaatttatttattcattttctagtttatggacgtttggattatttttattttgagggagtagttatggataaagcttgtgtgagcatttttatacatcattttggtagacatatgtactaattttgttggctatatacaaggagtgggtttactgagtcatagggtaggtatatgtatttttaaaataattattttattttttttaagttctggggtacatgttcaggatgtgcaggttacatagataaacatgtgccatggtagtttactggacctgttaacccatcacctaggtattaagcccagcatgttttagctcttttccctaatgctctgcttccccaccctcccccaacaggccccagcaagtattgttcccctccctgtgtccatgtgttctcactgtttggctcccacttataagtaagaacatgcagtgtttggttttctcttcctgcgttagtttgctagaataatggcttccagcttcatccatgtccctacaaaggacatgatctcattccttttaatggctgcatactattccatcatgtgtatgcaccattttctttatccagtctatcattgatgggcatttgggttgattccatgtctttgctattgtgaatcgtgctgcagtgaacatatgtgtgcatgtataatatactgatttatattcctttgagtatatactaagtaatgggattgctgggtcaaatggtatttccggttctaaatcttggcggaattgccacgctgtcttccacaatggttgaactaatttacattctcatcaaccatgtaaaagtgttcctgtttctccacaaccttgccagcatttgttgtttcttgactttttaaataaccaccattctgtctggcgtgagatggtatctcattgtggttttgatttgcatttctctaatgatcagtgatgttgagctgtttttcgtatgtctgttggctacatgtatgtctttttttgagaagtgtctgttcatatcctttgtagggtaggtatacgtttaacttcagtagaaactccaagcagtttcccaagttgtaccagtgtattcacccaaaagcattaggtgagagtttcatttgcttcacattctcaagaacacttccagtgagtgaagtctttcgccattctgggaggtgtatatttgtgtatcattgtcattttaatttgcatttctatggtgctgatgatgcgcgagtgcttctatatatgttgactggccatttggatattgatattctcttttgtgaaatttctctttagatctttacccctttaaaaaattggattgtttgccttatttattattgatttatagtaattctttatattatgtattttatatacaaaacttttgtgggatatatgtattgggaatatcttctcctggtctgtggcttatctcttactgttttaatcttaatggtgtcttttagagaacaaaagttcctagttttcatgaagtccaacttatttttttctttagtagtttagtgcttttgaatattaatttacaaaatctttgcctacaggaagatcacaaagatattgtcctacattttgttctagaagttttatagatttatctttcactttttttttaggcagggtcttgctctgtcactcaggttggagtgcagtggtgcaaatatagctcagtgcaaccttgacctcctgggctcaagtgagcctcctgcctccgcctcccttgtaattgggaccactgtgcatgccaccatgtccagcaattttttgatttatttttatagaggtagggtcttaccatgttgcccagcctggcctcacactcctgggctcaaaggatcctcccgccttgaccttccaaggtgcagagtctatagctgtgagccaccacacctggctacctttcacttttagatatgtgatctagaattaatttttgttcatggtgtgcaattgggattaaggtttttgtttgtttgtttgttttactggtttacagtgctctagcaccattaattgaaaagattgtcttttcccttcagactttcagtggtctttttcataaactaagtgactgtttatatgtggatctgtttttggactctgttccattggtctatttatgcattctttggttgttgtcagactctccaatataataaattttgaagtctggtagtgtcagttctcaactttgttcttaaagattgccttggctagtctaggacctttgcatttgtatgtaatttttaggatccttaggtcaatttccacaaaaaaacttaatggaattttgatttggtttgcattgtatctatagattaatttggggaggattggcatcatagcaatattgagtcttttgaaccatgagcatgatatatttctccatttatttacatcttaaaatttttttctcaatttttagttttcagttgtagatgtctttattcattggtattttattttcttatgttattgtataagtggtgtttcataaatttcatgtttgattgttgttgttagaaatagaaatagaaaaatcttgagcttgtattaaacaaccttactaaatttgcttattcgttgtagttggtatataatcatgttacctgttttctttttgatctttatactttcccacccttttattgcctgttttcctgactataacctttagtataatgttgaatagaagtgatgatagtggacaatcttcttttctctttaacctttggggaagtattgaacattttaccaatctaataaatagattggtattagtggtaggtttgtgtgtatgtgtgtgtatattattattactattatttttggtaatagctaccttttatcagattaaggaagttcccttccattcctaggttaccaagagctttttttaaaaaaacgataaatgaatgttaaattctatcaaatactttttctgcatctattgagatgatcctagaatttctctgcttaattttgttaatgtagtgaattactttttaaaaaaattttaatttctttttaaagatgggtctcacttcactgtgcctggatattacttaggtttatttttgaatgttgaaccaacactgtattcttggaataaaccccacttgattatgtatattatgtatattatccttatatattgctgggttttctttgctaaattatcatttttatttttaaaagttttcatctgtgttcatgagagatgttagcctataattttcttttcttgtgtccatatcatgtatgcatattattaggcttatgctggcctcacacagtgcttaggaagtgttttcttctctttctattggctagaaaaatagtacaagattgatttctgttatttttaatctgtatgataatctctttttctctttttaaaatttgtgaaatagtcatcaaaatagagtatggttgtcttcttttgcagctgaagaaactgaagcttatagaatttaagtactattagatagctggtggttactgctctgtattgaaaaccagttctgttttacttcaaagcctttgctatacagtatacatggaggaaaatgagtgaccaggtgatcatatggggatcttaagaaataccagaagttgttcttttggaaacttgtaagcttcttttaaaatcttacttcctgtcggtctaagaagggcactcttgatgaatgcttcttagttgtttgtgagggttgtggcttaaagtagctaagctttataattctgttggctctgtcaaatgaaaagtctatccattccaaaactgaacaaataagttttatttctgtgtgagaacaaatggttacttggaatttactgggatttttctttttccaaatccacatagtactggcaacatcttttttttctttgatgttaagatatttccaacattgattctttacagtatatgataggtcaagggattccattcatcatatactgataggtccaaggatgagggaaaaacttcatacaagggaaatataaggtgagttttaagatgaatctagtaccttattttcccacaagtccaaacattattacttttttatataagaaaaatgtttagctgttgtttcatgtggaaacatcttttcttcctttaagtgatatagaatacttgaaaaactattccttgttttcgttaccaaagaatttaggttttctaacaattgtttcctaatgacttctcattctgtagctatttacatttttttcttgaagattttattggaaatgtttggcgtctttatgagttttcagcaagttttgatgtcgtttaatcactaaagtttatactatgccagtgatgttattttatttgcttaatatgaaaaacctcaataagtttgtctcatttccagttaacttaattagaacatttggctccctctgaaactgcttctcatttttaaagcagaaggtgttatttagtgaaacctacaaaagaataatgttagagaaaattgtactttttagctgaaaaatgttctgtgttaataaattttagagctagaaactttttcgagagctcagttaatccttctgggacttttgaaattgctatctcagtggcagtatttcttgacaaatacagtattgagtgcttttaatgatcttttgttaattatatatggctccgacagtagagatttgagtttggcttaaatgaataaatactatttttacccatggtcaccttaaaaattggagttaaagtgttggcctgctggtctttttccttctctttagttttgctagtaatagtaagttttatttgccattgtataggcttaattggttaacatgtggctgctaatatttagtaaggttaatttttagtatgaaaattaagagtttcattttggtttttatataaagtgaagctatgtattaatagatttggtagttaattatgctgaataacaaaagtctaatatttggatgatcagtatattagtagaattagaaatacttgctcttgaagttgtttaaaaattgagatagaaaaagaggaagttgattttattaatgctgtaaaactgtcaaaaataagtatttagaaaggcatatttgagtgctaaattacttatgaactgacaactgttaattctttgcttaaaattaaaatcaaagtataatgccattaaaacaagtatagaaaaggcatgccagtttcccccatatttagggtattatttttcaaaacatttgctgaattaaaaaaaggttacttaaatttcaaatgtgtgttttcctctaaatgaaaattttccctttttcctcagtgtttttctgatgttcaagtggcagtaggtgtgggaagccgttgcaagcagtatctcccaagagtgagcttattctcctattgtagatatcaggatatcattgctttccttttctgcactgtatcatgttttagttattttatggaaatctatcagagtggaagagcaaaaggtcagttggaagagaaaaaagatgaaactgaaactaaaagtggttaaatatacttacattaggtatcaattactacttgtatattatccatgttacattttaaatttgcattggcttttttgttgttctttaggtaccttgctaggattattgattttgttcattatgagcagatctgagtgcctatcatgtacataatatttctgtgaccagttcattcattgtgctcaagtgataataaccaattttaatattaattctgtaaaacatatagcgcttaatattcctcacatatggagcttaatcttcccccacaaattttattttgtatattttaattgcaaaaataaaggatttattcatattgtagctagtttgcatcagcatgaattaataagtttcactatttttcttgttagcatttttaagttttattgaattagatgggtaaatgaatagtaattatattatctgcagtgtaattatctttgatttcagttattcacaccatctctttacaagtgataatcaaaaattatttcaaagtttgaaaatttttaacataaaatttctgctcaatttttatactttttaaatttccttcaagtaatatatgcacatagttaacaataagatagtaccaaaagacttaaggtgaaaaatagcagtcttctttctatttctgttccactctacagtcctgcactccaaaagcaattactcctaattttttccccatttcttaaggtatttacctacataatttaaaataatatggctcttctactaattttttggcttaagcagttttcttatgataattgaagagttagctcttttattatgcctctctccattctttctccattctcttgctatagttatgtcatgaatttaaaatctatttttggtatttatattacttgattatggaaatactgtttatttgtgaactaagtagttcactttttttttttaaagcatccagtgttactattaataagtagaaagccattctgatttctctctggaagcgttcaagatttcctttacccctggtgctcacaagttttgtgatgctgtgctttgataagtgtctttttttcaacctttgtgctgatatttgatgggtctttttactttttaatttttggggaaaaattcatgtgtgtgtttttttttctcttccctttttttgattctttctgggcttcctgttagttgaaaattctgttccctaggttaatttgcctaatttttaaagtgtttttctcctatagtttatctcttaggctttttgtcttatttttctagttgtccttcacttcatctttctgtccgtctactgaattataaaaattgtattatcatagttttaatttcttagaggggttccttattctctgttcccattttaatattatgtctttgattcatgggtacaacatctattcttatttttctgagattattaataagagtttattgatgtcattcctcctacttcctaatttcttttggcacattttggtctttgcttttctgttgcaagcttttgtcagattcttcaagtcttagttcttgcaaaagcagaatctaaaataccctatctttggtttatttggaaggtgattccaggaattataatgagagaataaggaggtgagacagggaagagaagaagtccagtaaaaggtgtattgattttgtgggttatcgtttggagcagctggagctcaatactgctggagactttcagagagactgtgtagaactgcactgtctaatactaatcactagctacatatggctattaaaattaaaattaaaatgaatgaaattaagtaaaattagagattcagtttgcattcacaccagccacactttaagtgcagatgtagaacattagacagtgcagatatagaacactccaattcagtccagtccagtgcagatataggacatttccatcatggtttataacataccttagaattgtaccatggaggttcaggaaaactgacctatttatctaccatcatctgtcccttattgattaagagttgctcctagagttactgactccctgtcacttatggcctgcgccacacaggggctgtgtcatttctgctaccttactcatttccactgggtacctagtaacaccaaatgcagagtttctctagttcatttttttctagagatccaaatcctggtcttctgtcagtctgaggcaagtagtcacttgactgaatgtggtggagggaagatagtcttttataagtatgcagatttttaaccaaattgctcatatttttttggggaaatcttaccccagtatcccatggcaactgttacattcgagttccaagcctttggaggattccatggagtaaattgacttcttattcttgtcctttaccacaggcattctgattgcagttttccctgatctgcaaattactaccactctgtagcttaagaaaaattatgatatatagtatttcaaacatgtggagaagtataaagaaaaaatatgcttgcaattcatatagtgctgggataaattcaactaagccctgtagggttgtctttttttttttaataccaggaatcttttgtttaaattttaggagacttgtcaccactcagtgatatcaaggctgctggggttattatgtcctttttcttctcctttgctgtgtttaggtggctactagtttattgagaaatttttggtctatttgcataagagatcttagcatattataatgttctttctatgtaacatttgtctgcatttggttttgatgtccaggtaacactagatttatgaaaaaagtttgtgttacctctttttccgttatgtggaacagtttgtacaaaattaatattagttgttccttaaatgcttggttgaactacccagtttaggcccggttgtttgtgtgtgtgtgtgtgtgtgagacattccttcttactagtttaatatttttctttttaaaacaccttaaatgtagttttttcagttagagtctgttagtggtaagttctttttgtgtttctggaagtttctttgtttaactctcactcttggatgatagtttagctgggtatagaattctgacaagtctgttttgagttttttcttccttaaatcttttgaaaattttctaagttttttcttattttcagtttggcttgatgaccatgtggcttgatatgtggcctgaatcttacttaaatattaggtctatagatttaacaagtgaaaactaatttttataattcatttcctagtttttatttagataccagcaatattcatgataaaaagtaccatatagtctcagatatctttaattttaatggttagaattatgttaaaatattaaaccagcatgtctgaatcatgactacataataaagcctattgatttaattggtttgaggtgggagtccaagcctgtattttctttcagtgtgctcaaataattctaatgtgcagccagaggttaaagaacatgaagttacaaattgagctgtaaattcagagatattctaatacaaatctcaactgtctttttctttttgttttgtttttatttaaaaagttggcagcctaaattcaaaatgtatgtggaaagacagatcaatagtcaaagcaataaaaaagaagtacatcattggatttatagttcctgattttgagatttacttaaagacaatgtggtattagtgatagaatggatattatggacaatagacccacacatacatattcagttggtttttggcaaaggtggtagggcatttcaaaggaggaagtaataatatttacaacaaatgtgctggaaaaactgtataatacgtatgtaataaaatgtatactgactcttacctcacatcatgcaggaaaggtgaacttaaaatgtgtcatagacctaaatttaaaactaaaaaaagctgtaagacatctagaagaaaacatagaacacagaaaacacaaaccataaaagaaaaaaattcataaactggaccttgtcaaaattaaaaccttttgttctttaaaagttatcaataagaaaattaaaagataagggttaacataggaaaaatatttataatacatatatttgagaaacgacttatatattggatatataaagaactcttacaactcaatgaaaagaaaataattgactcaatttaaaataggcagaatatttcagcactgctactacattctagaagatttgaacatgtaccattttcattccttggaaaatagtttggcagtttagcatatgatactggaattctctcctaggtatttatccaagagaaatgaaaacagatatccacacaaaaatttcgtcatgcatgtttatagcagttaattcataatagctgtaaactgggaacacccaaatattcattgcagatgaatggttaaacaaattgtgctctatccctaccagtagaagggaatgaactatgaacacacacatggataagtcttaaaacattaacaaaaacatgacgctaaatggaggaagccacatacaatatattctgtataatatcatttatatgagattttagaaatcaaaaactaatttatggtgtcagaaagcagatcagtgacttggggtagtggtaggagagtttgactgcagaggcacatgaggtatcttttgttggtgatggaaatgttttgtattttaattttgttggttgtcacacagttgtacaacatttgttaaaaataatcaaactgcacattttaaatgggtgtatgcatattttattcaacaagtttgacgaaggaacttaggaacactaagttggacaatctcatgagctttttttgtgatttcaaatccatgttagtggttaagctacaatgtttattgttgaatgtgggtatttactatggaggaagtgtgtgtatggtcttagctcatttacaaataaaatattttaacctttaattgaatattgatatagcatgatgttaactttatgttacagttactttctgctgtgtattactgggaatgtctttcggtacttatatagaaataaggtaaaaaagctatacaattaaaaatgtggcaatagtcacttcaaatcttttatgtgtgcctactaaagcaaacaaaatactaaacttgttttatatgtgttcaataaactgctgaacaagaaaaggatgcaatggccatgttgttagactgttggagtaagtgtaatagcaataacctaccttcctttttaccttcctttctccccctctccttccctttgtttctccctccctccttcactcccttctctccctcttctacctatccttatttccctttgctggtgacagtgcaagttgaatttgtacactgatctagattcagattagtataataaatttttaaaaatatcaagttgaatgaagaaggaaaattaaaattatacagtacctgaaactaaaaggctaaataaatggattcatcttttaaaaaaagttacattttctgagcatctataattcagttaagaaggtgactgaaaattgcagtttactggatgatcttgggaaaattactcactgtgtttctcagttttctcatttgtaagacaacaataatatgttgaaaggattaaatgaggtaatgtatttaaagtgcgggcacatagtaactactcaataattatttgcctgtcatcatcatggtcatattcaaagtgaaatttcttccacatctgaccttggctattttaatatatgtgttactaagcaatataatgtattttaaagaaaaatacggtgatatgccactttcaaagaaacaaaaaagatgtgcattataaattttagatcataggtgaaattgtacttattatcaattcattaggtgcatacaatacacatttagataggagcattgttaattcatttttagagtttttgaccactttcatacatttcaaaatggctttgaagacataactgcagttttcatatttttcatactttagcattttggtacatgccatattagaatgtatcttagacatctgataagtgtcaagatttcccccttactctgttatctagcaaatattgagtacctggtatgtaccaggtgctggggatataacagtgaagacaatctagatgcctctgtcatggaacttagatttcattgtttggggagatactggggaggaaagattggacaagacaacacataaaataacaagataacttcagatagtaataagtgatgagaagaagaaaatgggatgatggggtagaacatgcctggaaggactaatttgggttgtgtggttatagaaagcctttgtgagatgacatttgagcgaagacctgagatgaagagtcctgaaaatctggggatggattttctagtcagtggggacaggagttcaactgcatcttagacctgatgaacttggtatatttgaattcttacaaaagatgaatattgctaaaggatggtaattaggtagaagactaataaagtagaggagggtggaaagatagccaggacctatctttcacagatagccttgggcatcatttcttactgagtctgtgaagcttgatgccgtaagcaaagagaaatatggaaaataagtggttggtattaacggtgtggcttttaggaaacaggcaaaatatcctggaagatttttattggggatttggaagtataataaaataaataatcattaactttgtatgccgtggggagaaaccaggtctgattattgacttctctttagggaaacatcagtttgtaaaatgtgttttgaaagcagcagaggaggtaatatgggcatactactctttccctcccattaattctttagacttcttctttgatattttactgagagtgtggggttttccccctgtatatatgatatttgtgatgaagaaaggcaaataatttagctagagttcaacactttgtttcctactctttggtcaaaacataaatagtatttggataccttatagtaacatacaaggagaagtgactagagagagcttgtttggttaagatcactcatttaagtagattagaaaagtatacctatggagaagcatcccttggaaggtaagactaggttattttatttagccttcttcttggttgcaatggtttggatgcttgtcctcttcaaacctcatgttgaaatttgatcttcagtgttagaggaagggcctaaagggagatatttgggtcatagggatgagtccctcacaaatagattaatgacttccattgggggtgagtgagttctccattaattcctggaggagcttgttgttaaaaagagcctggtacttccttccatctctctcttgcttctttttttgtcatgtggtctatgcacactggcttcccttcaccttaccccatgagaggaaacaacctgaggccctccctagatgcagatgtccattcttgaactttccagtcatcagaatcatgagccaaataaatcctttttctttataaactacccagcctcaggtattcctttatagcaacaaaaaatggaataagacattggctaagtcctattataaatatatataagtatttaaatgtgttttttacatatggggacagcttagagtctcaaatattagacgtacctaaatgtaatacatggcttctagactggattctataagcagtactataaagaatgttattggatcagctgacaaaattgtactagtacagtaaatctgatgcaggtatttagtgatgttgatttttctggagtcgataactatagtgtggttatgtaagagaatattcctcatcttaggaaatttacattgaagaatttaggactaaaaagcatgatgtaagcaacttactctaaaaaagttcaggggtgaattatatatatatatagagagagagaatgtaggtgtatgttaataataaaacaaataggacaaaattttaacaatagatggatctggataaaggacatataggagttctatgcactaatcttatttttgcacctcttctgtaagtttaaaattatgtctaaataaaatactaaaaatgggttaaagttattttttgtttaaaaataatttcaaaatgtagctatatctcattgtcagaaatactatcaattctatgttgagtttatcaagcaaaattccaatgttagtacaatgatcaagtgttaaatattgggttacaaactaatattttttgaatctagaggtagaaaagattagtgtggattggatgttagaactgtgaaaaaaaagtgcagagtggtgaggtagttaagagaaactggaaagaatgagctggttgagaattcagaattggagaaggtaaatttagtagttacccatgtaaatgctaccattgtagagcaatgttttgtagtcttttgcagtcttcctgaggatacttaccatgttttattgaattttaacgtgcacattttttttcacattaaaaaaatctctgaaatcagggtgtaccttataatcagtggcatctgataatcacatcggtgtggattaaagtcagtttttccatataagatttgtggttttgcctgtaacctgggggcactaccagtaacctggaggcactaccacttttcttctgccagtaacctggggacagtaccaacctgaaactattttaaattatcttttgtgtttgagtacttggaccaccctagtgtgaattcggattacagatttgtgtgtgttctggctggtggttcaaatttggagaggagatagcacctctctcccccgcaccactagtgccaagattgagaagacaaattcctgtgctgttgctttccttgtaataggtttatttcccctttactcttatacgttttttgtcacagtcttcttatgagggttcctgttagactattggatattttttgttgttttcagttatatatgaaaataatggtgataaaaatactttttttcctgcttaactttggtgtccttgctttttggatatatgttcttaattgtattattcctattcatggtttcacagatatctttaatctcaccctatccaaaggaattctaaaggtaaaataacaccctacattgatagcttggtccattaagtcatttgtcttggggaaaagttgtagcataaagtcatagtcagtttttggttaggaggaccttatagaagagatgaatgagcatacatacaccctggagttagtccaagttttggattctctgaagcttacctctgtaacttaatctttctgaactttagtttcctcatctagagaatggtttgtgatattactgctctgttaatgttattgtgctccttcaatgagatagtgtatataaaggtctagtgtgggctctggcagagatgtggtgctgaatagatgatttatttttttgattgattgtgattgccattatttttggtttcctaggacatcctcttccacccagtccctcttcttatggaaatatatcttgtccaaccatcccctcccaccaaccacgagagaggtgggcacattattcatcctggccaatttagattaatcctctaaatataatggtaggttcacgtctgagtgggcatgtgaccaaagtccatcagagtcttttcccatcaggattgatatacagggaatgggggaagaaaacctctctaccggaattacaaaggttggatttagatccaaagccactggcaactaccatctaattccatatggagaagtctgcttaaataatgaagctaaggagaagctatcaaggataagagatggaggttgagggttggggagggcgaaaaagagagggaggagagagacagagactgagggagatccagttccatttttttaggctatccttcctatagctcttctttcagagatatgccagtctcctttccagctttgtgaactagtaaatgctttttttaaaaaaatgtggtttaagttggatttctgtcacttgcagtgaagagttctgatgaatatgataatggtgttatttgcccaaagaacttttcttgctcaaagaactgcctatattgctttcttgctaacttgttaaagactagtatataataggctattacatagaggatgaatgcctggaaaaagaaataaaaattatgatttttttaaggaagatctctgagtttaagattttttccatgtcacattattatttctagtgatgctatagggataccgtattgcaagtaaacatctatagatgtacaaagaaaatttgcagtcttaattttaattagaaaccatttaccacatttagaagctctgattaaagatataatggataaaagggataaaattacatttgcagttatttgtttttaatctttaatgtcccttcttatatgactctcagatagagtgagcagggcccaacttgtctgaagcttaagaggtgacccagaatataattgagaggactagaaaggtatattagactattcttgcattgctataaagaaatatctgagatggagtaatttataagaaaagaagtttaattggcttacagttctgcaggctgtacaggaagcatagtgctggcatctgcttctggggaggcctcaggaagttttactcatggcggaaggtgaagtgggagcaggcacatcatatggccagagcaggagcaagagagtctggtgcgggaggtgccggactttgcaacaatcatatctcaagagaactcactcattattgcaaggatagcaccaagccatgaggaacccgcccccatgacctaaacccctcccaccaggtcccacctccaacattggggattacaattcaacatgagatttgtaggggacatccaaactatatcaaagggcaatggatcagtgtcagcattcactgctggtaaaaacagtatttgtattcttaatttggttagtctggataggagccaaagattcacagcatggccgtattcacttggaagtttgcaatttgattaaggtttgagaacatgtcagggaaggaaagaatttcctttaaaatcatcctgcacactgaatacctaaagtagtacaaataatttgttatggcctgagaagctaagaaaaaatttagtcattcttctaagtccaagaatggctgtaggggatagtacatgagtgactatcctgtctacttctgttttctgttttattttgtatattttttagaaacaggatctttctctgtcccccacactggagtgcggtaatgcgatcatagctcactgtaacctccaactcctgggctcaagctgtcctcctgcctcagcctcccaagtagctaggactacagacgtgtgccaccacacctagctaattttttattttttgtagagacagggtcttactatattggctaggctgctcttgaactcctggcctcaagcaattctcttgtcttgggctcccaaagcactgagattataggagtgagccaccacgcccaatcctgttttcttttttgaggtgcgttaaatatttacattttacctggagtttggaaaagtagtttatttggacgtacaagcttgttttttttttttttttttttttttttgagatggagtcttgtcctgttgcctgtgctggagtgcagtggcatgatcttggctcactacagtctccgcctcgcaggttcaagtgattctcctgcctcagcctcccgagtagctcggcttacaggtgcacagcaccacacccagctaatttttgtatttttaatagtgacagggtttaactatgttgggcaggctggtcttggactcctgacctcaagtgatcctcctgccttggcctcccaaagtgttgggattacaggcatgagccactgcgcctggccaaggtgtgtttttaaagtagaagttaattctgtggattgatttaaccaattttctttgcaagcaattgtataggagaattaaatacaaatcctcctactgatgtcagatttagataatgccttaatatgatgtaatatcttaaatagtgaactgtttggttataccttgtgccatgatttccttaatatatctcataaagttgtacaaagaataagattgagatgctttactgttaggcacatagacatttatgtaacattcattttaaaaaatttgaataccaattatgtgtaaggtactaggataaacacaaaggatacaagaagtctttgccttaggccaatacattctgatagagtgttaaaatagttacacaagtatctgttactcaaagcattaattacataggtgttatatatattaagtatataaacattatgtatattaagtgccttgtgctgagtatcaactaagtgttttaagatcagagtccatttggggtttgtgatggttaattttatgtgtgaacctcactggatcacgggatgaccagatatttggtcaaatattattctgagtttctatgagagtgtttttggatgagatagatggattatgagtagagcaaaaaggcagactctcccacatataagagagaattctttcctacctgactgccttcaaactgggacattggctttttacctgcctttgaacttgaactgaaacattggcccttcctgggtcccaagcttgctggccttcagatggaaactatactgccagctttcttggttcttaatgcttcagacttggactgaaactaaaccattggttctccaacttgctcccacaactctgcacatgttaggtcagcctccacaatcatgtgaactacttccttataataaaaaatctttacacacacacacacacacacacacacacacactcacacacatactattgtttctgtttccctggagaactgtaattaataaagggtgacttggaaaggcatcacagaggaggtggaatttaagccagaggctaaactatcgtataagcaggatttcagtagataaagatggtgaagaaaaacactacaggcagaggaaatagggtatgtgatggaagcagtctcaagtagtataatttggctagagttcaagatgtttctactgtttttttgcatttcagaagagttgtgggagaacaccagttttaccacaacctggctagtacttggtggtagtgtggtagtggcagtggcagtgcgcgtgtgactttttttttaaaaaatgactgtagcaggttgattgatgattggttaaagaggaagtctgctttctcagcattctggttaatctaacctgagatcatttttcattactctatcatgctccagtccaggggaggggagggttatagtcagaaaaaaagaccgtataaatgtgtatatatatgtgtgtgtcttgctatttgtattggttctcatagtttgcaaagtgaatatgatgacattcttcccttggccctatttttagcttgcttttctcttagtggacctaagttatgaaatagcaaaggtttatatagctttgaaattcatgtttttagctgggcgtggtggcagtgcctgtcgtcccagctactcagggtattgaggcaggaggatcatttgagcctgggagctccaggctgcagtgagccatgcctacacctctgcattccagcctgggtgacccagctaaaccctgtctcaaaaaaaaaaaaaaaaaaaagaaatacatgttttataccctcagatttaattgcttattttacatatttgaccatccatttcctgggatgactgatgccccaagatggtgccaatgtggaatggcagtactgtttagtaggactttctccagtgtccagtgtggtatccaccagccacacatagctattgagtccttgacatatggctagtgtggctgaaaaatggaattttaagttttatttaattttaattgatttaaatttaaattgtaacatatagctagtggttactgtatgagacattgcagttctggagcttaagaagttttggcttgtttctagctctctggtgttgagaagggctgaccaagcagtattttcactcatatttaaaatataatatcttaaatattcttaaatattctattggtgattacacagcaaatgaattttgatattgccaattcttcagtaaaattaggtatttattaattaattgtttatgttctgcctcattccaaataaagattgtatgtgaatgataggaaatgatctattaaaggtacaattattaaaataatgataaaagaaaaagagccatgtaacaaatgaagtgagaagagaagcaagaaaaggggaaaaatcaggtagcgtgatgcctccagcttttttcttttggcttaggattgacttggcgatgcgggctcctttttggttccatatgaactttaaagtagttttttccaattctgtgaagaaagtcattggtagcttgatggggatggcattggatctataaattaccttgggcagtatggccattttcacgatattgattcttcctacccatgagcatggaatgttcttccatttgtttgtatcctcttttatttccttgagcagtggtttgtagttctccttgaagaggtccttcacgtcccttgtaagttggattcctaggtattttattgtctttgaagcaattgtgaatggcagttcactcatgatttggctctctgtttgtgtgttattggtgtataagaatgcttgtgtcttttgcacattgattttgtatcctgagactttgctgaagttgcctatcagcttaagattttgggctgagacgatggggttttctaaatatacaatcatgttatctgcaaacagagactatttgacttcctcttttcctaattgaacaccctttatttccttctcctgcctgattgccctggccagaacttccaacgctatgttgaataggagtggtgagagagggcattgcgacactattaacagtagcaaagacttggaaccaagccaaatgtccaacaatgatagactggattaagaaaatgtggcacatagtgggaggagccaagatggccgaataggaacagctccggtctacagctcccagcgtgagcgacgcagaagacaggtgatttctgcatttccatctgaggtaccgggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatactgcgcttttcagaccagcttaaaaaacggcgcaccacgagactatatcccacacctggcttggagggtgctacgcccacggaatctcgctgattgctagcacagcagtctgagatcaaactgcaaggcggcagcgaggctgggggaggggagcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcaggaacctctgcagacttaaatgtccctgtctgacagctttgaagagagcagtggttctcccagcacgcagctggagatctgagaacgggcagactacctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgagggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggtagaaaccctacaagccagaagagagtgggggccaatattcaacattcttaaagaaaagaattttcaacccagaatttcatatccagccaaagtaagcttcataagtgaaggagaaataaaatactttacagacaagcaaatgctgagagattttgtcaccaccaggcctgccctaaaagagctcctgaaggaagcgctaaacatggaaaggaacaaccggtaccagccactgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaatgctccaattaaaagacacagactggcaagttggataaagagtcaagacccatcagtgtgctgtattcaggaaacccatctcatgtgcagagacacacataggctgaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcatctctgcaccaagtggacctaatagacatctacagaactctccaccccaaatcaacagaatatacgtttttttcagcaccacaccacacctattccaaaattgaccacatagttggaagtaaagctctcctcagcaaatgtaaaagaacagaaattatagcaaactatctctcagaccacagtgcaatcaaactagaactcaggattaagaatctcactcaaaaccgctcaactacatggaaactgaacaacctgctcctgaatgactactgggtacataatgaaatgaaggcagaaataaagatgttctttgaaaccaacgagaacaaacacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagactgctagcaagactaataaagaaaaaaagagaggagaatcaaatagacacaataaaaaatgataaaggggatatcaccaccgatcccacagaaatacaaactaccatcagagaatactacaaacacctctacgcaaataaactagaaaatctagaagaaatggatacattccttgacacatacactctcccaagactaaaccaggaagaagttgaatctctgaatagaccaataacaggagctgaaattgtggcaataatctatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgagaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactatactacaagcctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagagactaccatcagagtgaacaggcaacctacaacctgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaatacatgaaaaaatgctcatcatcactggccatcagagaaatgcaaatcaaaacactatgagataccatctcacaccagttagaatggcaatcattaaaaagtcaggaaacagcaggtgctggagaggatgtggagaaataggaacacttttacactgttggtgggactgtaaactagtacaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccgacccaaatgtccaacaatgatagactggatgaagaaaatgtggcacatatacaccatggaatactatgcagccataaaaaaggatgagttcatgtcctttctagggacatggatgaaattggaaaccatcattctcagtaaactatcgcaagaacaaaaaaccaaacaccgcatattctcactcataggtgggaattgaacaatgagatcacatggtcacaggaaggggaatatcacactctgtggactgtggtgcgggtgggggcaggggggaggggtagcattgggagatatacctaatgctagatgacgagttagtgggtgcagcacaccagcatggcacatgtatacatatgtaactaacctgcgcaatgtgcacatgtaccctaaaacttaaagtataattaaaaaaaaaaaaaaagaaaatgtggcacatatacaccatggaatactgtgcagccgtaaaaaatgatgagttcatgtcctttgtagggacatggatgaagctggaaaccagtctcagcaaactatcgccaggacaaaaaacaaaacaccgcatgttctcactcataggtgggaattaaacaatgagaacacatggacacaggaaggggaacatcacacaccagggcctgttgtggaatagggggacgggggagggaatagcattaggagatatgcctaatgttaaatgacgagttaatgggtgcagcacaccaacatggcacatgtatacatatgtaacaaacctgcacgttgtgcacatgtaccttaaaacttaaagtataattaaaaaaaaaagaaaaggggaaaaatctaggaaagtctagtcgagggtagcaaaaaatccatctgtgtcaactggcagatagagtaaaaaaaataaatccaataaaaaaataacatttttatgtaatgagacatgccattgagtcaagagagaaactttttccaaagacgaaacaaggagaaatttattccgttttgtaagatttgttgagtagtatagtggacggcatcgtttaatagcaattttacaaataatagagacatttttatcatatatttacatcaaatcttggtaaaaagttttttgaagagctaaagcctgccaataaccatgtgagcgagctgagaagcagattctgcagagctagtttagtcttgagatgactgcagtcctggctgacagtttgattataacctcatgagagaacttgaaccagaggcactcagctaagccactttcagattcttgacccacagaaactgagataaaaaatgtttgttgttttaagctgcttagttttggggtaatttttttatgtagaagaagctaactatgttatgatattttttttagaatggaggtgcttggtgttaaatgataaatagatacagctttctaaaccttcaaatcttatttatgaaagtacatttatagccttatatgtttgagggtgtaaatatagttaggaaaaatgttgaaattaagtattttcactagccatcctaaatggcatctggccatttgaatgaatgaaaaatagctaataacaatagataacatgtattgaactctttctctgtttcagaaactatcctaagcatgttatggacattgtatcatttagtccttacagaattgtattgagtacttcagactttaaaaccaaatcactttgactccaatttagccattgtactaaccatactgtgatcaggtaacttctgaggtatagaaattcatgtgttaaacatctgagggattcttaaattttgatggatgctggagatatagtggtgagcaaagggagacagaacctcagatctcatgccacttacaacattttgaagtacatagacattaatacaataaatacatatttacagactgaggtcagtactatgaagatgagttctgagatcctttaataaaagcaagtttctggtccaggcacagtggctcatgcctgtaattctagcaattttggaggctaaggtgggaggatcgcctgaggccaggagtttgagaccagcctgggcaatatagtgagaccctgctgctacacaaatttaaaaaaaaacccattagctgggaatgatgatgcacacctctagtcctagctactcaggaggctgaggcaggaggatcgtttgggcccaggagtttaaggctacaagtgagctatgattgggccactgtactccagcctgggcaatagagtgagactccatctcaaaaaaaaaaacaaaaaccagtaaaagcaagtttttattgttgaagagcaatggtatgcttacaaactgaaagaagggcaacaaggttatagcacagaaaacaaaaagaagagtggtgtgagattaggctggaaagatatgcatgggccagactagcaaggccttggaaggtgatgttttattctacttcctaagggaagctatcgaaaagtttttaacagatattatgttaaggttttctttttggaaatatcattgtagttaaaatatggacattgtagacatgccatagtggctatggggagactcttaggaagctgttgaaataaccaaacaaaaaagatggactaaggtattggcaaaagttttttcagaaatggagagaaatagacttgaaagatggttacaggataaaatcaacaggacttggtgagaaaattgattaccagggggttggggagaaggcattgttaagaatggtgaaaagatttcctacttgcctatctgtgtgtatgatgatgctatttattaagggtacagaacattaataggaagggggacacatttggtggtaaaactcattagttagcttttgccgaatttgagatatgtttgagacatccaagtttggaatgttgagaaagatgtacaggttgaacatccctaatctgaaaatccaaaatcagaaatgctccaaaatctgaagctttttgaatgcctataagatgcttgaaggtcatgctcaaaggaaatgctcatttggagcatttcagattttggatatttggattagcgttgctcagccagtgtaatggaattatgttattctaaattctgaaatatgaaacacttctgatctcaagcatttcagatcaggatactcaacctgtattagattggatcacacagaactccaggccagagataagaatgttcaaggaatgggcaaatatatggtaattgatgtaatggttaagaatgccttgtgagagggagtgagaagagaagaaggcctagaagttgaggaactccaatattaactggccaaactgaagaggataacctacaaaggatatagtagaaggattctttcactcatttatttatttattcaacagatatttatcaagtgcctattatataccaggcacaaatatggaatccagggatatagcagggataagatagtcaagatctttgctgtcatggaacctaaactgtagtagaaagtacgtaaataaacataaatactttagataggtacaggtactaaaaggaaatagaaaaggattatgtgactgaggaagggaagactagaagaggaacaaggcttttgaggaaaatcaagaacttccttctttttagccatgctacttttgaggtatctatatccaaatccaagtgattaataggggctgctgcatgctagtaaatagcaccaccattcacccaaattggcaggctcaaacttccagcagcttttttctttctttcgttctttctttctctttctttttctttctttctttttctttctttctttctttctctttctttctttctttctttttctttctttctttctttcttctttctcctctctctttctcctttcttccttccttccttccttgcttccttctttctctttttcttttcccttccttccttccttccctccctccacccctccctcctttcctccctctgtccccctttccctttccctccccctcccccttcccttccccctccttctccccttcccttcccctcccctcccctctccctcctcctgcctattctctcccctctccctccctcccccttccctcccctcccctctcctgttctctcctctcctttcctttcctttttctctctctctttcttatactccatattcagtccattagcagctcctgactactccatctttaacatttgtgctcaatatgattacttcaattatatgcactatttctttactctaagccaccattttctcttgcctagactattggagtaacctctgttctgatctcccagcttccaatcttgtccccatataatctggtattcacattgcagcccgaatgatcttttaaaaaccaaaattctttgatcatatgctccagttgtttcctataatatcgacacagtttaccatggcaataatgctctatatgatctagtcacttttttgactgcattttggaatgctctttccctctacttcagcttcactggccaagactccgctattccttgaagatatcagtattattccagacttcagggcatttgcatttgctgttttttcacttggaatgctcttcccccatattttcacttagcttgctccctcacttcataccagtctctgttcagctgtgatcttatgaaagaggttttccctgaccaccctatataaataagccttctttgacacctgcctatcattctgtattcccttagcccatttttatttttcttcatttcacttatcatctaatatgttcttgtttattattttttctttccctctagaatgcaaagaccttgtctgtcttattaatgtctgcatcccaacagccaagaataatgcctggtatataatatgtgggttccataaacatttttttttagtgaatgaatgaatgaatatataagtctggagctcagaggagatttcagtgctgaaatgtaaatttagtagtcaatagcatataaatggtcatttacactgtaggactggatgaaattatcaagagatagtatggagccaaaccagaaaagggacccagattcaagcctttcgctgatttttcatttataaatcagattagaaggacccaacaagttaggaggaaaaccaggagagacatatcattgaaactaagagaggaaatgttctaaggacacagctttgttggataatgcttacaggctggattaagatgtgtttgtaaattaaccattggatttgcaaagatgaagattgttttgtggcttttaagagttatttcagtggagtggttggggtagaaatcagactggagtatgacaggtgaggtagggagagtgaagtagactcctttgagaagtcttgctgtgaagaacagagaattgaatgatcattgaacggaggaaatgtaatcaaggaaggacttaagtattcccccagagttttctgaatttgcaattcattcatcttgattatctccccttgaggtctagctgtcatcagttaactggaggattgattcataatccctttttgcaaggtggcaaagcttacctttctcctcaaacctatctaccaaagttctctttcttctttaatttcattagagtccttggtaaatgattcacatttctttttgttataactcttcagtaaattaagcctttgcctttcttgctgattttaccgtattatataactatcatagatgatttcaaatgttaatagtgatagaaactgtaataatataatactaacatgtattgatatttactatgtggggtcttttgaagaaatttacatttttttaacttaatattcaaaacaaccatgggaggcaggtgctattattatcctcagtagaggatctaaggatctgaggttcagagggcttaggtaatttcctcaagatcatatagttcataagtggctacaggtatgattgtagagcttttgctgttagccaccatgctattctgtctttaagttaacaaagtaaatgtttcatcttctaattatgttaaactaatatgcctttggtgaattgttttggtaaagttaatacttctttttctccacttttatatctgttatgtgaatttatgtcttagactggattattggtaactctattatttttacaataatcaaatgttagggctagatgggacatttaattacataatgaatggaataaaaatctgctaatcagatagatctgttttctaaactgcattttttctcctttgtcttttttggcctaccctgttggctgtgaactttattttaaaattcatttgtgcttataacaataataagcactatttattccttgagtggttttacaaaccttacaaggcttaccatttccagagtgtcagagtagctatagcaggtttacacttaaatatactcttggttttatgacattccattttgacagtgatgaagagcatgcttataggcatcgttgaaaaggaatgttagaactgtttatgtgatagttctacaagtttcttacatttatctattatagaaagatctatcatacatgcttacttttcacagagtttataatatatgcatatgttttaatggtttgttataaataatatgattagctggcaaaagcttttagcaatttaaattttggggttattttaaattatgaatttaaacaagctctttcatttcaggtggttggctaaacccactgtggctgatagtgttatataaagttgttttctagttttgaaaagctaaaagtttatgtttttatgctttctgtgaaagtcactaatacttgtaacctaatgaaaatgtttctactgctacaattgtggagaaattttgaaaacctagatttagtcagtatttttcatgctaacattgtaaagaatgtcagaggccatggagaggatctaagggaatcagagaaaaggaagaggaagtaacatttttagagtacattttatgttctaggcaactcagtaatagggcagtatatcatttcattctcacagaagtctttcgaggtattataatttcccttttacagatgaggaaactgaggttgcagaggttaattatgttgataaagatcatatagataagtagaactaggattgaaatctagatctacttgatacttaagcttcctcttacacttgttttatggagttgttcttgggccttcttaaacaggtaattattctatgtcatagcagaattcttgatagaattatgatatttaaatttttatttactcagctatcataaacataaaaatactatactactatataagcttgcaggtcttttgaatataaaaactaaactgcatgttgactcatttatcagagttctgtagaataattaaaagtaattataggaggtcttttttaagtgtatgtagtcatttgtattatttgaaagcttagacagcttttatagcagtttgcttccagaccatgctcattgatgcattgaagagatacccgtgaaccaccttgtctactcccatacagctgatttatctttgtagcagtccctgagttagagaatcttccctactacctctgctatagttttcagtaaattgggcaagatcaaatgtttcctggagataatttccttagctcttgtattagatcccaacagtaaatacattattgactgatgtgaacacagaaagcatctcaaactttttgttgatcagagcatagctcagttgttttaggaattccagataaaatgacagtaatgtattgtgattatttccttcttttgaaatgaacttgaatatacttttatgtttatttgtaaaataacatttcaaagatcacattgtgcttatttttacagtggcctctggctgaaagcaataaagttctgtcctgggtggaactaggctagttgcagtttctcaaatttcttcaatgagatgctttgcttttgtgaaaataagtcatattgtccactgccacctttgtttacttctccattttatcccctcttggttacagaaattagctactacaaataaaatgccaagattttataattttctatgtttaaatttgcaagtaaaaagttctgttgaaacatttgtaagatcaaactaatgtgagataaatatgactgatattcagaagttgattaatctaactttcagtactgtacctattacataaagtatgattaatctctatgtgcaagtatataaacaaattttgagtataaaatcataatctaaaattttgttttatatttaatggagtgttcaaatactttgtaataaaaacaatggatgactaaaatgattgaataagttatcaaatagagctttgtaaactagggttcatagttgcaaataatagaaatcaactctggatattttaagaactaaaaaaaaaattgaaacgttactgagaagcttacagaatcactgagagggttgtagaactaggctcaataaaaggatcagaataggagaggttaggcagcaaataggaccacaaccaaaatcacagcacatcagtctggtgaatacatgcatggctaccaccaaaaatgaacactcacttgcccctcacgttagccaatgaatgctgtctcttccactgctatctaagaacctcgatgttgctaccatcagtttccagaatggattctctgatactcccctctgcatcattatctcccagtttaaagatgggtgtttctgagtagctgacctaaggtcacatactaatactgtaactacaagaatagttgggaaagtgaggattggatattttcagattgtgtggagaactaagctctgtggtctatcaacactcctcaggtaggtaatttctaagtgtaggaaagttcagatgttgggtggccaaaaatgtacagatatccactacatttccttgtgatagcatctaagttctttccatttcattcttttataaattcttttaacattattgttgcataagagaaaaaggcataaattattttaaaattttagattcagagacttggttggacacatgatattactctggatgttcttagacgtttcaggccatttcaaccttattttagttattactttaacaagtttctgcaaagttgtggttgtattaatagcaaacatactaatagtgctatttgagcattatcagatatcataaacatagtattctatcccttcttctgaaagatatatcaacatttccctagatatatccttatctttgtactcactttggagaatgagctctaaaagtataatggaaggaacaaaaactttagagccagatttgggatcagatgtgacctctgtcactctgtcatcatcatttggtatctaacattagcagttattctcattttagatatgataaaactgaatcatagagaggttaagtagctcaagacttttaaattaaacatgaacgattaaacattaaaaagtatccagaaaaattaacttactttttttctaaatgtagtataaatatttttagtgcatctcaagtatgcagtgacttagatacccatattccaattacagatgtctaattttttaacttacatacaggaacaggtaatcatgttagatcagtttgtctcagttccttgtgttttatgtttagaatgttggggatattttgttcatattctaaataactatttgttatacccttccaccatcatttaatatgttaaagttttaaagcattttactttgatttttttttttttttttttttgagacagagtcttgctctgttgcccaggctggagtgcagtggcactatctcggctcactgcaagttccgcgtcccgagttcacgccattctcctgcctcagcctcccgagtagctgggactgcaggtgcccgccaccacacccggctacttttttgtatttttagtagagacggggtttcatcgtgttagccaggatggtctcgatctcctgacctcgtgatctgcccacttcagcctcccaaagtgctgagattacaggtgtgagccaccacgcctggcctttactttgattttttaaccttacaacaccccttgtacttgtataatgtcatttttacagatgtgggaaattaggaatatagattaaaaatgacatagttataaggctatagtttagttctcacagagaaactcagtcatataagttaagcgtttttgttcccaaatgatagtcatagtagtaaaagaaatttttaaatttcacttatttattcagaaagtgcttactgagcgcctagtgtgttctgtgcactgacttaagtgctggagatacctaagtaaatcagacgatttctgctgtcatggagcttatacacttatagagggaagtagaaaataaatgtaaaaaatattttcaccttttgataagtaagtgctgtggaggaaaattaagcaaggaagggtaaaggggaattctaggggttaggaaaggggagttataattttaaacagaattattgaggaagacatcactaggaaggtgacatctgagcaacaaaagacctaaaggaggtatgggaaggagacatgcggatgtcttggagaagaacattataggtagagagaagagcgaaagtccaaggccctgagaatgcagcatgtctgacacgttcaaggtgaggcaaggtgcaggtggggggcagtatgttgaaagcaaggtaagcaaagggaagagtaaaaggaaatgagatgaaaataatgaaaaagcatacgaaagcaagtgattttttcttgggtctagatttcatactggtacctaactttgcttaatttttctgttgttaataggagctgttaatgcccagtcaatatatcagagaatggagtttgagcaactatagtttaatgaggcaattaaattgagaaccgtggctttagactagttcaatatgaagaacagattaaatgtactctgaggaactgccttttaattatagatttttgagattcattttagtgtcatttttttcatggttaaacaacatggagaggaaagtaatgatcttataaaatagaagtgttcaagataacttactaggatggatcatctgtgtttgccaaatcaaacagggcaatttaaaatacagttgttccttggtatacatgggagattggttccaggactcttgagtatatccaaatctgcacatactcaggtcctacattagaccctgcagaacccacgtatacaagtttcacatcctgaacttactgtattttcagcccgtgtttggttgaagaaaagccatgtatataagtggacttctacagttcaaacctgtgttgttcaagagtcaactgtgtatcaggttagcatataaacctgttttgttttgcctaccataaaacactgatctttagattgatacaattgctgttttattcattggttcatatacacctaatgagattgctattttaattttcattgttaagacacacttaaattcctaatacttaaaaacgtatatgaaaaatttattttcacaaatcgatatacctattttttgaacagtagtatgcatattgctttacaaaatgacagtgtaaaaatggcattcagattcccgtttctaagatgcttgaacattttgatttttactcattagaagtttaattgttattagtcaacaaggagaaacaatgaggaacttacagaggagtgtcagttgtattgaaagattaggagtgaatgttttatcttgtaaaaagatatctcagcccctaggatggtctacagaaatgacaataagctccgattcttattttaattttttattttttctgtttctctgtctcctgtcttttcctgcgcattctctcttttactcccaacctctcttgtttatttctttggatccgtcaaagttggaaattgaacagtatttctgatatattatgtagtatgagttctgaaatcttggtgaattaaattcatgaatgctaccatagtgattttattaaggtgtggcttttgattacatgttcttcaagctagggttatgggagtcagctagtaggtaggcttagtttgattgtcctactttaacatttgtttttccttcttgaaataactttcatgaagttagatacaggcttttgtacaggatcattttgtgggaaatggtgggtctgaaaagtaagccattggtattgataaaagcagagagaaaatgaaaaagaaaaaaggtaggaaagatgtgccttttagccaataaatagaagtttaaaagacatgaaagaatgagatgtaatttttttaggagctctaatttagccatgaacacagccaccattactctgcagaaagggaaaaaaaggggattctgtttcagaatttgctgtattaaaaactatttgagaaagagaacactttattgaaaattgaaaattattggctaacattcagtgtgagggtatgtcgaagtaccatccgactaaaaacaaattaagtgtagtcgtgagtcaaacatattgtttcttccaaaatttaaattaaattagtttcatatgagtgttttctttttttcttgagacagggtcttgatctgctgcccaggctggagtgcagtggcatgatcacagctcactgtagctttggcctcccaggctcaagtgatcctcccacttcagcctcctgagtagctgttactacaggcatatgccactacacttggctaatttttaatttttttgtacaattgggggtcccactgtgtttcccaggctggtctggaactcctgggctcaagcgcctccagcctccagctcccaaagtgctgggtttacaggcatgagccactgcacccagccaattttatgtgttgataacaatcttgctgaacttactgtttcttataacttataggttgttcttcttgggattaccaagtaaatgtcctttgcagtagtgacactttttctttcttttcaatctaagattttgcttttttctctgattgtgtaaagttagcacttctaaaacaatactctcagcatgtattgcatgattacatactttttcttcttatattaataatatgaagtatattaattgaatgctcaatattgaattaatcttgaacttctggaatatgtcatataattctattcttttaaatgagttattatgaaaaattttaaccatacagaaaagttgaaatttattcggtggaaatctgtatatcctctgtcttaatttaacaattaacattttgctatatctcctctttttttttgttagaccacttgaagctgtttttgagaatacagattccaatacaaccacaaaaaccttaccacatctaagaaaattaatactgattctatcttatgtaatatctgttctttatttaagtttcccgaaatatccccaaaatatcttttatagctttcatttttttccaaaccaggcaaggtttatacattcattgcatgcggttatgtctctttcatctctttcaatctagaatagcccaccccatcatcttttcttctgttggacagttatactaatatgcagagatgatgtcatatttttcactacagaaaaagcactcataaatatgtataaatgtatatcgatcataatgcttgagaaggaatgggcattggacccatacctctgcactctggcttgaaggaagatgaaaagtttctagatacaacagaggaaatgataatatagagaagtccaggaggtacaaagtctgtgtgacaaagatagaaagtagaggaatgtgatacaaagggagaaataaaacctttgaatcttggagctatataataaatgttaagattcttcatactgaggttgtgaagcaggacaatagtgaagaggaatactgaagaaattataggagttttaaaaatgattacaagatatatcctatatagagagaatattacaatttctggtgaaaactatcaaatataaggggatattctccagaacgaaaaggtgaaagaaaacacctcattggcactatgtagaagaaatgggttgtaattatccaccactgcacctgccagccacgaatggctgtttaaacttcagttaaactagttaaaattacataaaataaaaaatctagtccctcagtcacactgaccacatttcaagtgctcaatagctatacatagctagtggctccatattagagtgttttcatcatcgaaaaaagtttaactggccatcactgcaatagattcaatataaaggtatgctggcttttagggtacacattcaaggtttggtagggagcctattaaaactgatcaaaatccttgattgttatttagtctggatgaatcacataggggataatgacagtgaggaagagaacacggaagcatatttagagtcctcacaaaaaatctggatgtgctgggaataataggttgtgtgtgtgtgtgtgtgtgtgtgtgtgtgtgtgtgtgactccttattgttgattgacacagtggaacaatgaaggaagatagtagaagacaagtaatctagttttacctgtgctcttctctcttgcaaggtagaaggctaagcctttgatccaggctggaggccctgaaactgggattgataggatgggcttattactgtggccctgaactgaagcccagttgagggcggcctgggaagcaaggcatgaacacagccttgataaacaaaatgagtaaaggatgcacagttaagagccaaaaagagaatagcctgaacgtgtagaaggaaactaaagctacaagggagttaaaagctggttgaagtgagtgttttgggggttttctgtgaattaataattttgaagaggaaacagccctggtgcgtggggcacattttcgtagagaacacaaagaaaagaaaacctctttggtacatattttctttcagtatttttgggcaaggagaatgatgtactttttactgacaagagtataactaaagttgccattaacagaaataaagcccagttatcataaaggaactgaagtccaagattaaagaagattatagaaaagtacttgattgattgttcataaacatattcaaatatcccaatacagatgaattttgtcctagggtattgagataacttacaaaggagattagcaaacagactatatatttttttaagacactatagagaaggagagaggttctggaatactggagatagatacatgccattctgattttcagaagggagaaatgaaggttccacaaacaataaatcaattggtttgacattgaccttagaaaagattaaaggggtgggttttgatcatctgagagagatagtagtggtcactaagaaaagattaaagaagtgggttctgaacacccaagagaggtagtagtggtcattaggagttagtatgggctcatggtgcataattgtgacagattgacttttcaagtccaccatgtactagctgtgcaacattgagtaatttgcttcatctatctgggtctcagctttcttatctttaaaatgaaaataaaaataatatctattacataggctcgtaataaagaataaatgaatttacatttgtaaaacatttagaacgaaatgtgatacataaaaagcacaatgtcagtgatagataaatagctagagagagaccaacaggctgccttctttttttttttttgagatggaatctcgctctttcacccaggctggactgcagtggtgcaatcttggctcactgcaatctcggcctcccgggttcacgctgttctcctgcctcagcctcctgagtagctgggactacaggcaggcgccctgccactatgcccagctaattttttgtgtttttagtagagacagggtttcactgtgttagccaggatggtctcgatcttctgacctcgtgatccgccagccttggcctcccaaagtgctgggattacaggcgtgagccactgcatccggccacaggctgccttctttaatcaaacttgtagctccgtgaaatgaaacagctaatgtgcaaagattgtagcagctcttctttaaaaaaattgaggtgaaatttgcatagcctaaaattaaccattttttttattattatactttaagttttagggtacacatgcacaatgtgcaggttagttacatatgtatacatgtgccatgctggtgtgctgcacccattaactcctcatttagcattagttatatctcctaatgctatcccttcccccctccccccaccccacaacagtccccagagtgtgatgttccccttcctgtgtccatgtgttctcattgttcaattcccatctatgagtgagaacatgcggtgtttggttttttgtccttggggtagtttactgagaatgatgatttccaatttcatccatgtgcctgcaaaggacatgaactcatcattttttaaggctgcatagtattccatggtgtatatgtgccacattttcttaatccagtctatcattgttgaacatttgggttggttccaagtctttgctattgtgaatagggccacaataaacatacgtgtgcatgtgtctttatagcagcatgatttatagtcctttgggtatatacccagtagtgggatggctgggtcaaatggtatttctagttctagatccctgaggaatcgccacactgacttccacaatggttgaactaatttatactcccaccaacagtgtaaaagtgttcctatttctacacatcctctgcagcatctgttgtttcctgactttttagtgatcgccattctaactggcgtgagatggtatctcattgtggttttgatttgcatttctctaatgaccagtgatgatgagctttctgtcatatgtctgttggctgcataaatgtcttcttttgagaagtgtctgttcatatcctttgcccactttttgatgggttgttttttcttgtaaatttgtttaagttctttgtagattctgaatattagccctttgttagatggatagattgcaaaaattttctcccattctctaggttgacttttcacttcttttgctgtgcagaagctcttgagtttaattagatcccatttgtcaattttggcttttgttgccattgctttttgtattttagtcatgaagtctttgcccatgcctatgtcctgaatggtattgcctaggttttcttctagggtttttatggttttaggtcttacgcttaagtctttaatccatcttgagttaatttttgtataaggtgtaagaaaggggtccagtttcagttttctccatatggctagccagttttcccaacaccatttattaaacaggatatcctttccccattgcttgtttttgccaggtttgtcaaagaccagatggttgcagatatatggtattatttctgaggctcctgctctgttccattggtcgatatctctgttttggtactagtaccatgctgttttggttactgtagccttgtaatatagtttgaagtcaggtagtgtgatgcctccagctttgttctttttgcttaggattgacttggctatgcaggcccttttttgggtttcatgtgaaatttaaagtagttttctctaattctgtgaagaaagtcaatggtagcttgatggggatagcactgaatctataaattaccttggacagtatggcccttttcacaatattgattcttcctaaccatgagcgtggaatgtgtttccatttgtttgtgtcctctcttatttccttgagcagtggtttgtagttttccttgaagaggtccttcacatcccttgtaagttggattcctaggtattttattctctttgtaacaattgtgaatggcagttcactcatgatttggctctctgtttgcctcttattggtatataggaatccttgtgatttttgcacactgactttgtatcctgagacttgcagaagttgcttatcagcttaaggagattttgggctgagatgatgggtttttctagatatggaatcatgtcatctacaaacagagacaatttgacttcctttcttcctatttgaataccctctatttctttctcttgcgtgattgccctggccagaacttccaatactttgttgactaggagtgctgagagagggcatccttgtcttgtgctggttttcaaatggaatgcttccagtttttgcccattcagtatgatattggctctgggtttgtcataaatagctcttattattttgagatacgttccatcgacacctagctcattgagagtttttagcatgaaggggtgttgaattttgtcgaaggccttttgtgcatctgttgagataatcatgtggtttttgtcattggttctgcttatgtgatggattacatttattgatttgtgtatgttgaactagccttgcatcccagggttgaagctggcttgattgtggtggataagctttttgatgtcctgctggattcggtttgccagtattttattgagaatttttgcatcgatgttcattaggtatattggccaaattttcttgttttgttgtgtctctgccaggttttggtatctggatgatgctaaactcataaaatgagttagggaggatttcctttttttctattgattggaatagtttcagaaggaatggcaccaactcatctttgtatctctggtagaattgggctgtgaatctgtctggtcctggactttttttggttggtaggctattaattactgcttcaatttcagaacttgttattggtctattcaaggatttgacttcttcctggtttagacttgggagggtgtatgtgtccgggaatttatccatttcttctagattttctagtttatttgcatagagatgtttatagtactctctgatggtagtttgtatttccatgggatcaggggtgatatcccctgtatcattttttattgagtctatttgattcttctctcttttcatctttattagtctggctagcggtctgtctattttggtaatgttttcaaaaaaccagctcctggattcactgattttttgaaagattttttgtgtctctatctccttcagttctgctctgatcttagttatttctggtcttctgctagcatttgaatttgtttgctcttgcttctctagtacttttaattgtgatgttagtgcatcgattgtagatcttttctgctttctcttgtaggcatttagtctgtaaattcctctctaaacactgctttggttctgtgccagagattctgatatgtagtgtctttgttctcattggtttcaaagaatttattcatttctgccttaatttccttatttacacagtagtcattcaggagcaggttgttcagtttccatgtagttgtgcggttttgagtgagtttcttaatcctaagttctaatttgattgcactgtggcctgagaaactgtttgttatgatttccattcttattcattttctgcagagtgttttacttccaattatatggtcaattttagaataaatgcgatgtggtgctgagaagaatgtatattccgttgatttggggtggggagttctgtagatgtgtattaggtctgcttggtccagagctgagttcaagtcttgaatttccttgttgattttctatcgtattgatctgtctaatattgtcagtggggtgttacagtctcccactattactgtgtcggagtctaagtctctttgtaggcctctaagacttggtattatgaatctgggtgctcgtgtattggctgcatatatatttaggatagttagctctttttgttgcattgatctgtttaccattatgtaatgcccttctttgtgtcttttgagctttgttggtttaaagtccgttttatcagagactaggattgcattttttttgctttccatttgcttggtaaatattctgctatctttttttgagcctatgtgtttttgcatatgagatgggtctcctgaatacagcacatcaatgggtcttgactctttattcaatttgccagtccatgtcttttacttggggcatttagcccatttacatttaaggttaatattgttaagtgtgaatttgatcctgtcattatgatgctagctggttgttttgcctgttagttgatgcagtttcttcatagtgtcgatggtctttacaatttggtatgtttttgcagtggctggtactggttgttcctttccatgtttagtgcttcctttaggagctcttgtaaggcaggcctggtgatgacaaaatctctcagcatttgcttgtctgtaaaggattttatttttcctttgtttatcaagctttagtttgactggatatgaaattctgagttgaaaattcttttctttaagaatgttgaatattggcccctactttcttctggcttgtagagtttctgccgagagatccgctgttagtctgatgggcttccctttgtgagtaacccaacctttctctctggctgccttatcattttttccttcatttcagccttggtgaatctgacaattatgtgtcttggggttgtgcttcttgaggagtatctttgtggtgttctctgtatttcctgaatttgaatgttggcctgccttattaggttcaggaagttctcctggataatatcctgaagagtgttttccaacttggttccattctccctgtcactttcaggtgcacaaatcaaacgcaatttggtcttttcacatagtcccatatttcttggaggctttgttcgttccttttcattctgttttctctaatcttcttgctttatttcatcaagttgatcttcaatctctgatatcctttcttccacttgatgagttcagctatcgatacttgtgtatgcttcatgaagttcttgtgctgtgtttttcagctccaccagatcatttatgttcttctctaaactggttattctagttagcaattcatctaaccttttttctaggttcttagcttccttgctttgggttaggacatgctcctttagctcagaatcgtttgttattacccaccttctgaagcctacttctgtctgtcaaactcattctccgtccaattttgttcccttgctggtgaggagttgtgatcctttagaggagaagaggcgttgtgttttttggaattttcagcctttttgtgctggtttctccccatctttgtggatttatctacctttggtctttaatgttggtgacctctggatggggtctttgagtggacatgcgatttctttctgcttgttagttttccttctgacagtcaggcccctatgctgcaggtctgctggagtttgctggaggtccactccagaccctgtttgcctgaatgtcaccaggagaggctgcagaacagtaaagattgctgactgttccttcctctggaagctttgtcccagaggggctctcactagatgccagccagagctctcctgtatgaggtgtctgtcaactcctgctgagagatttctccgagtcaggaggcacgggggtcagggacccacttgaggaggcagtctgtcccttagcagagcttgagcgctgtgttgggagatctgctgttctcttcagacctggcagacaggaacgtttgtttgctgaagttgcacccacagctgccccttcccccaggtggtcccagggagatgggagttgtatctctaagcccctgactggggctgctgcctttatttcagagataccctgcccagagaggtggaatctagagaggaagtctggctatagtggctttgccaagatgaagtgggctccacccagtttgaacttcccagcagctttatttatgctgtgaggggaaaaccgcctactcaagtctcagtaatggcagacaccccttcccccaccaagttggagcatcacaggttgacttcagactgctgtgctggcagcaagaatttcaagccaatggatcccagcttgttgggctccatcagggtgggatccactgagctagaccactgggctccctggcttcaactccctttccagggtagtgaacagttttgtcttgctggtgttccatgtgccactggggtatgaaaagaaactcctgcagctagctcggtgtctgcccaaatggctgcccagttttgtgcttgaaacccaggaccctggtggcgtaggtaccagagggattttcctggtctgcaggttgcaaagactgtgggaaatgcgtactatctgggccgcaatgcaccattcctcacggcacagtccctcatggcttcccttggctaggggagggagttcctcaaccccttgcacttcctgggtgaggagatgccccaccctgcatctgctcgccctctgtgggctggacccactgtctaaccagtcccattgagatgagctgggtacctcagttggaaatacagaaatcactcaccttctgcattgatctctctgggagctgcagaccagagctgttgctattcgaccatcttgccagccactatcaaagagattagttttatattgttgagtgttcttagcacctttgttgaaaatcagttgaccacagatatataggtttatttctcaattctcagttttattccattgatctacatgtctgtctttatgccattaccatgatgttttgattactgtagcttttataatcagttatgcaaccagctatgtgagtcttatactgtttcttttttcctttctattcttttttctttgatttggttattcaatgttcttaaaattctgtatgaattgtaggatcagttttttcatttctgcaaaaaaagtcattgggattttgataggaattgcattgcatttttagtttgctttgggtgatattgccattttcacaatattgtcttccaagtccatgaatgtgaatgtttttccatttagttaggtcttctttactttctttcagcaatgttttgtagttttcattgtcaaagttttgtactgccttgattaagtttattaccaagtattttattatttttgatgccattgtaaattctgttgtaaagatggattatttcatctatatctcccatctcagttctttctcttaagatcccaatgtgcatacacagagaataaaataaattgagtagtagatttagttctaagcatcctgaaaggctggcaaaaaggaaatgagatagggaagcagggtcagtgtatgtgactttctaataaaagagaagaacttttttctggaactcaactctaggagaaaattattatgagaacttttgcattagggacatgaaataacattataaggataattttaatgttttataggaaacatatttttaatattgacaatgaataaaagcccaggggatagggttataatttagctcagtcatatagtataattgttctttaagtgtttatcctttttgttaatttataagctctgtgaaaatagcttttttgtttttttgtttttattttatagagacagggtctctctatgttgcccaggctggtcttgaactcctgagatcaagcgatcctcccacctcggcctcccaaagcactgggattataggcgtgagccactgcaccagccgaaggtagcttttttggagggagactgtgttttgttcttttcacattccctagagcaagtgcctcacaagctgtttacaaaaataatttttttctgaattctgtaattaaatatctgtgaaatttataaactgactttgaaattttagtggttctttaaaatgttatttcttgattcagagaaagaatactgtatctggataatcacttatttttaaggttttggttttttgcttgagtcttgtttgtgatctaactatattgattaagttattatacatacacacacacagcagatctaatatggcatttttttttaaccacgtacttttcttgttcctgttgtggatcaaccattatttctttgtatttagctacataaaaaaaactatcaagaaatatataaaaatgtacttttagaagtattgatttctgctcaccatcatttgtcaactttgatgttagacagctactagttagctggaattcagtgccaaatgaagtcagaggtggataggaatcttttattatgtatattttttttattttccttctccttttatttttcctcctttcctcgctatactttttcccttcaccattttttttccaccctccctgcctgtgcccatctaaagtacatacaaggattgtttagcctgtttgacaggaaaaggaaaagaattaatgtatattggctggattctcttggaattttgtgagatcagggacctgaatctgaatcaggtaacatccatgatagttattccacatccccatttgctatctgattcagattcaggtccctaataacatagcatccatgatagttattccatatccccatgttctatgttatgttgtccagctcttcccttcaggactgaaagatttatttccccagctgctaggaagattgtccactgacaggtctcatcaggaagccctctcataaaattgttgaaatgtctaacgagagcctgtcttggccaggtgccaccgcactcatgcctgtaatcccctcactttgggaggccaaggcggatggatcacttaaggtcaggagttcgtgaccagcctggccaacatggtgaaaccctgtctctactaaaaatacaaaaattagctgggcgtggtggcattcacctgcaattccagctactcgggaggctgaggcacaagaacccaggaggcggaggttgcagtgagccgagatcgcaccagtgcactccagcctgggtgatggagtgacactctatctcaaaataaaataaaataaaaaataataaaataaagctgtctttaaaaagctaatgccctttttctagggcagctcacattaaatgagttgttgatttgatgctgtaaaggcttcaccctctctcaacccaatttaggacaactctgaagggatgtcttagttgcccttttctagttactagactaggatgttttaaaagctgaggatataaacttacctaaatgtttttgtattcttttgctaatgagaaataatctttcactggtgtcatgttttgagatatttgaaagctatccttaggctcatttagctgtcacttaaaatattaagcattacataaggttaaaaaaatggaatagtggcaagagtatgacccagaaagcatgagtgaggctgaaaagaatacgaggatcctttcgatggtaattttggaagatcctatttgaaatagtgatcttaattatgtagaatttcatttccatctctatggctttagtcactgttacaggacatttttgcatcactataaaggaatacctgagactggtaatttataaagaaaagaggtttagttggctcatagttcttcaggctgtacaggaagtgtggtgccagcatctgctcctggcgagtgcctcagtaagcttacaaccatggtggaaggcaaaggcggaggaggtgtgtcatgtggcgagagccagagcaagggttgggggaggtgccatgctcttttaaacaacacaatctttaaaacaacataatcttttaaacaacacagtcatcaccaaggggatgatgctaacccattcatgaaggatccagccccatgatctagtcacctcccagcaggccccaccttcaactttgggaatcacatttcagcatgagatttggagggataaacatccaaaccatatcagtcactctgttttgtttcagagtgaatgatacttacagaatcatagtattgtaaagccctttgatttgccacttttgactagacttacacaacataacacaaatatcaaagcctcaacattgtaaaaaataatataacatgaaagtgagtgagtactaggaagagtaagtgctgtcatgtctttctcccatagagaagacagtcagaagatagcctaaacagaatctgttattcattgtggttgactccaggggatagggacaaagggaagtgtatagttttcattttaagcctttatgtgctgtataaagtttttaaagaagcatatcgtgtgcataatccctaaaaaatcaagcaaccaaaatgtagtggtgatggtgggatgtgtgtgtattgggggagggaaggaggggagaatggcttaaaaattaattcatttaaaatatttcttattttttaacttccatattttgaatcaaatgatttgcaaaaataatggattgttttataaacgcatgtaatatacatatttaagtagcaggtgtttcataaataccttgttatagaagtgcacacatttctgtgtttcagaattcaaaagcccctttgaagaaatagtcactatttgacttaccacatacgtaatgacaagaaatttacaagtataattagatttttagtgattaaattgtgcatataataattttaccaacatagtatagcatttcctttagcatttattatattgtaaatgagtgttataagcgagttataacctaaattctttaatgtaacctagttctttaacataatctaaatggtttaacataggcataggcctataatattagtaagaatagatcatatggtttagaattattttaaaatgttgaggattacttcagatcttattactgtaattccctatttgtgatgggtagccgttctgtgacctattaattgttctcttggatatgtagctgtttatgtttcagattggctgcagctgttttgatttgaggcagatggcctgaagaagcagcattcataaattaaatcacaattttttttctatgtatttttaaatcattctcagaaacctgaagtcttttcagtacagagttaatttcaaattcataatattctttgaattttcacataatatattaacttgatttttgtataacaatattcttttcatttttgtgaaatacataattgctaacttattttaacatagacatgagctaaagagaccctaattatatttttacacaaaccttatacaattatttaaattctgacccaaatagcagaatggttattacactgattctttaatcatttcaaaataggaacaattatttccaatggaattctcactttctaacttatttagttctctttttcattcattatggttttggaaagtatctgagacagctacatttattaactacactatagttaaggtaaaaagataatggtctttctcgtcattgttgaaatacccatactaaaatgatactattaaaaaaagagctaacttccttttaaggagtggtctatagcctttctcttttctttcttttttttttttttttgagacagagtttcgctcttttgcccaggctggagtgcagtggcgcagtcttggctcactgcagcttccgccgcctgggttcatgtgattctcatgcttcagcctcccaagtagctgggattacaggtatgtaccaccatgcctgtctaatttttgtctttttagtagattcggggttttgccatgttgctcaggctggtgtcaaactcttggcctcaagtgatgcacctgcctcggcttcccaaagtgctgggattacaagcgtgagccatccacgcctggccaagaactttctatttttgtataaaactttttttttaaacatagattggtacatatgtaaatgaaaagtaatattcatgtagaaagagaagtgaagatcatctagtctggcctttcagtgcttgaatttccttaaacacattaactaaatagtaagctagcttatgcaggtactgatccaatgatgagtaactctatacctctgaagataatacattccatctttggatagcattgactagtgaaaagcaaatagttatactgaatcaaagtcagcttccttgtctttctttttgtttttaacctgttggccctagattctttggggctacacagaacggtttaagcagtcttccttatgacaatcataaaatatttgaggacagcttttatgactccacaatctctcttaccattcctgaagtttcttctctaaataaatacttttggttccttcagccattcttcatatgtcacaaaggccttctctgttattcagaatatactgcagatggtctctactaggagcagaatccatgaataggattcaggaaacccatggattttgatattagtcagggttgtccagaaaaatagaaccaataggaggatatttacacatgcacatcctcctatatcccataaatatatatatatttatttatatatatttaaaatttatatatttatagatttaaaataaatatatcccatatatatatatatgtatctttgtggaagctgagaagtcccaagatctgcatttagcaagctggagaccttggagagccagtagtgtaagttccaatctgaaagctggtcagcttgagacccaagaagagaggatgtttcagtccagttctaaagctggaaaacaccagtgttgtagctcaagctgtcaggcaggaagaattcctcctattcagccttttggttctatttaattgattgaatgaggtccaccagcagtagggaaagcaatctgctttactcagtgtactgcttcaaatgttaatctcatccagaaataccctcctagatacatacagaatagaataatgtttggccaaatgtatgggcaccttgaaactcagtcaagttaacacataaaattaactatcacaaatatgaaaaatttgtatccttatatttactaacttctgaatgagagtttatgattatttcaaatcataaatttgaaaatttatgattgtaagcaacagaccactatagcaaaactgtggcttcacaacagtagaaatcacagataactttatatccactatagttgttgcagatatttggaaatattgacattcattggttcttaatgtgaatattatatataatttcctaattataagaacatatattattgaatcatgtttattttaataatatttataatgtagatatgatataaattttattgactgattggttttctctgttttcttatgcattaaattttatgcttttaagaatattattttgaaaaggatccataggctttactagactgcaaaaggggtccattgttcaagaagtggttaagaacctttggtctatactttttctaaaagtgtaattttagaaaggaatacattttatgggtgtggcccattaacactgacataggagtagagattattatctccctgcatctacataaaataaaccaagatctcattcattttttttaggcagccagactgatcacactagttggaattagtccatcttttgattctagcctggtcttttcagaatcactctgttagtgtgttccctgttctacgtttctgtcatttacaaatacaataggcatgttgtctatatcacagattaccaaacctggctgctcatcagaatcatctgaggagttttaaaaaatagatttttagttcctccctcacatttagtcagaaacattgtgcacctggtgattatgcaagctgcctggcactgttctgtgaattcatatttggaaatcccattttttatataatttatgtcatttatagtaatatttttaaaaatgttatagaagttagaattttgtagtgttgcacttgctaagtctttccaggttgacctgcagcaccctggaggttccaatgattattactttatatcattactgtaattcattcttttctgttttgaatcagtttgtttcaagaaattgagtgcatctacctaatttctctgatacgccatctaataataaatcttggcaaaaaaggaaattgtcactcatttttctagtgagttgatataaacttatactaatcactacctcttcacctgatttgtcataaattattccttaaaacttgtttgtaatcagttgatatcagccgtattgttttggtttaagtttccctaaaagtcaagcatgaaacaaggacagtagtttatttgggaagtgatcccacaaagtgggaataaggaagtggtcaagagtgagacagggaagaaggaaatgccaatataagactatagtattgtagtggtagttttgacagcagaaactagattctgctgtgacatcctgaaaagtgttcagaaagcttcctagactttctatctgaaagataggcaacgagatttatctatcagctcttgttctttattggtcaaagattccctccatcccttaacctgggaaagttaactcacccatatttccaggctgcccttgctaacaggctgagtgggacattgtagtgccagtgaaaatcctgggacagaaagtggaaagatggtgaatgcatctttgaagtggcagtctgttaatgtgaggtaaatcttttcaggaaggttcaccacaagtatgacaaaaagtggactgagggactgtgacatgggttatcagtggtacttgctacactcatcttctgtattctaagaaatctacttttttatttttataaatcaattacatttgtttgtttctaagagtctttaaaggttaccaataacctcatgtgctagttctctcagtatcctgtgactataattcattctgactaagaacttggagtgacttacctgtcttgggctttagttctggcattacaatgtttgttcagaccttttcagtttctgacagagaaaactgggacaatctaggagttaaagagttttactttctctttagtggtattatactatcttctgaaataaggctttgttgttgttgttgttctatcttggtttaatctatcaaagaaaagaaaaagaaagaaaattccttttgttgtctcttgaactttgcaagccataggtaattttgaggtttgggttttttgagttcactggttaaattctttaatttcttttcccagctctcttctaaagttcctccctccttcaagttttatgctatggagtcatggctgtcttttctgtgagaacgttgaaatgttttattaaattttaaggagatccattgaatatatctagactttttctttatttgtggccatcacaaactctgagctgacatggtcactccttgcattttctccttgattctgataagccctggaatccttcatttaggtattacttgtctttgtacaagtcaaaggctactgttattcagtcacttttgtcctcctgccccattcttaatcttttttcttttgccttacccctcttttccacttcttctaaaagttatctagtattctagtataatctgttgacttttgctttctaaactatctactgtttgctctcatttattccattgctttgggatgcttattcagtgaccatagctaaactgataaactacttagtcttcaggtattaaggaatgatagtgtgtggaagtggtaagataacatatttgtgttttgtcaggagtctaggatccctgtttttcccctttgtttccctattcaccatccattggatcataggaaaaattaactgttaatgtaagtgaaaagtaacttagttctttggagggagagatataaaagttttgactcaggtgattttacaattacaagcatattttcagtatagatctttttgagtgccttccatgaaccacatactttattagtcaccgaggataaagaaggccaggaatattgttatcaaagaatctaataaaagagatggagatgtaaacaaatacttgaattttaatgtcgaagttaaattgaatgccctaaatgatggatatatttttttatgaaatatcttctgtaataacatgatgttctgataattcttgggtttataaattgaatcatttggtgtgtgaagttgacatattattctcagatgccaattctgatttctccatgctgaaaattacgatggtaagaatccaatagctttgatttccttaggtaaatattaggctaaacatccagtgctgtatcttcagtattttctaccaggcagaagaattgttatttttatgcctctgtgtttaaatgatagaagtaagatactttaattgaaaagagaataaaaaacaaagtatcccttttagaggatgaaaggggagcaggaactccccaggtttttaaatattttagtacataaaatatacacaacaacttaaaattgttacttttctgggaaaactgaagcacatgcaggagattttaaaaactccacttgatgttagatgattaaatagtgttttgctttggaaattgaaaagcaagacttgttataaaaatagttcattccataccaataaaatcttattggcttgtttatttttattttgtaataagatagagtgaatgtggaagcttgtgttttaagaacttcttgtcctgtttagattatgttaaataacatacaacattttttaaaacagcttttataaacaactaagactttagacaaaggaatatgagtatgtgatgaggcttgacccaattaggtaggcaaaaactttaaaaaatatttcatggcatagagggagaattagttcactttttattaattacttgttcttttctgagttacatgtatatttatgggaattaaatatttaaataattgggtaatttaatgtgataatctaattttaccagccagtttctttagcattttaattttcactgttccttaactctatataaataaacaaatcaagagaactcattattattaatatcaataatactaacaaatcatgctaacatttcttgagatcaatctctagagtaatatgtaagctctcatgtgtattatctcacttgatgtctcaataacctgagtgtgtagatattattattgctatgttataaacgacattacttaaaagaactctgtagtaaatcctttggaaaaataaatagtgttttggaatgtgagcatgcattcctcaatttatctattttatacatatatacttttgtatatgacaacgttttgttaaatatgctatttctagccaggtgcagtggtgggtgcctttagtcccagctactcaggaggctgaggtgggtggatcgcttgagcccaggagttcaagtccagcctgggcaacattgcaaggctccatctcttttaaaacaaacaaacaaacaaaaacagctatttttaggtctcttcatcctttattatttttatgaatgtcgccattatcttttgtgtctgctcagatttgaactctataggctcttttggctttgctccccttcttctctttcatgccctcttcaaaccaggaagttgcacagtcttggaaggacaatctctgtaatatttctcccattatctgttgtactttttgagctcaggactgagattgaaatttttctgaatgagaagaaccaccctcaaccacgattactgaacactgagtgactttggaagttaacttttgctgcagacttgataaatccatcctaaagttacaaggaataacagtttaaatgcaaaaatcatgttatagtaaaagtcattttgatgacaatgaatgttgtttgagtcacaagtaatgtcaagccactgtatatgtcacatcttgtcaaaagttaaaacaagaagttagatgtccattcccacacaaatttatggcagatacattttctagataaaattatagttctagcagcagttttcaaactaaaatacaagttagggattttccgtatttcaaaatctgtttaactgtgcaatcaaggaacttccaggtaactgtcaactggaaatgattatttacagtgtaatgacctgctaaaagtcaggagaagaatctaatagaattttataaataccttgtaagtgaggaatatacttaaataaaataacgtgcctgtggactggtatcaatatttggcagtgcttgtctgcgtgaaaagacattttcaaaaatgaaatatgtaaaatctcattacagatgaacattaacagataaacgttgattttgatgatagagaacaccagctttgagtcccaattaaaatgaaatactctttccccaaaagaattccattcttctcattggaagacccacattacaaaacattatattcacattattatattttgaattttgtcgataaaaactttatggaaatatatttgtattgtactaggtacctacataataaccttgattttgtctcttgggcattaaagtctaaaatatttactatctgacccttatatacaaagtttgctaactgtgagctaaacaattattcattcttttaagtgagctcatacctatcaaacacagagaaataagtctctactggtagagtttcaactattagtgttgaaaaaataattctacatcattcccagaacagactttagatgattatttactccaacttaacccattttacaattattttacaattaagaatccttattttacaattaagaatccaaggtttaatggaagctaaacattggtataactgaaaatggaactgagatattctcattttccatctagtgttctttctagtgaactttatttatatgcaagtgtttctgctggatactaagaatgataaaaaagaaatatgagaaatggtgtctatatcaagatatattataatctagttggggagtgtatcagtcagggtcccagcaagaataatacactccaatggactagttgagggtcatttaatgacagactatttataaaagggtggagagagttttgggaaataggcttttgccatcgaagcctaaagagacaaggggtggctataggagaggcccctcaagaggagctgtggcttttggtggaggaatccaactactgtcaacccacgctgtccagaaaggaggtgataccccacctacaaataccttgacctcattctcctcctgccctttcatctcctgctggtgcctcccgtagtcctaatcctgccaaaagccacatggcaaataacctttggatggagtccaaaaaggttagtctcctaaggaaaactgcgagttagagagtggatctgaagggacaaatggagaatatccacctcagagagcaggattacttgtatggtaatagcacatggtaacatattctaagtgcatgagcaatctggactacatatacttaatagcatactgacacacaagatatcattttaagtgcttattttttttttttattatactttaagttttagggtgcatgtgcacattgtgcaggttagttacatatgtatacatgtgccatgctggtgtgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgtggtgtttggttttttgctcttgcaatagtttactgagaatgatgatttccagtatcatccatgtccctacaaaggacacgaactcatcattttttatggctgcatagtactccatggtgtatatgtgccacattttcttaatccagtctatcattgttggacatttgggtcggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgctgtttcctgactttttaatgactgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccacttgttgatggggttgtgtgtttttttcttgtaaatttgtttgagttcattgtagattctggatattagccctttttcagatgagtaggttgcgaaaattttctcccattttgtagggtgcctgttcactctgatggtagtttcttttgctgtgcagaagctcttgagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccggtttcagctttctacatatggctagccaattttcccagcaccatttattaaatagggaatcctttccccattgcttgtttttgtcaggtttgtcaaagatcagatagttgtagatatgtggcgttatttctgaggactctgttcttttccattgatctatatctctgatttggtaccagtaccatgctgttttggttagtgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttcttcttgaagaggtccttcacatcccttgtaagttggattcctaggtattttattgtctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatccttctcctgcctaattgtcctggccagaacttccaacactatgttgaataggagtggtgagagagggcatccctgtcttgtgccagttttcaaagggaatgcttccagtttttgcccattcagtatgatattggctgtgggtttctcatagatagctcttattattttgagatacgtcccatcaatacctaatttattgagagtttttagcatgaagggttgttgaattttgtcaaaggctttttctgcatctattgagatagtcatgtggtttttgtctttggctctgtttatatgctggattacatttattgatttgcgtatattgaaccagccttgcatcccagggatgaagcccacttgatcatggtggataagctttttgatgtgctgctggattcgttttttccagtattttattgaggatttttgcatcaatgttcgtcaaggatattggtctaaaattctcttttttggttgtgtctctgcccggctttggtatcagaatgatgctggcctcataaaatgagttagggaggattccctctttttctattgactggaatagtttcagaaggaatggtaccagttcctccttgtacctctggtacattttttaaagtacattctttatctgcacaacaagtttaaatctgcaccacattcctttttacactgacatctggaacaaagttcagtctaattgtagttcagtagtagttcagttctaaattggtaggccacttctgctgctgcataaagttgttccactgtctatcagaagtagtttttttttttttttttttgagacagagtcttgctttgtcgcctggttggagtgcagtggcgtggtctcggctcactgaaacctccgcctcctgggttcaagtgattcttctgcctcagcttctagagtagctgggactacaggtgtgtgccaccacgcccagctaatttttgtatttttagtagatacagggtttcaccatgttggcccagatggtctctatcttgtgaccttgtgatctgcccgccttggcctcccaaagtgctgggattacagatgtgagccaccgtgcccggctacagatattgttttaagtggtttagagctcagcttcaggaggaggctaagtagtaagaagcccagaagttaaataatgcattgctattgtttatcagttgaaaattcattattttgagatttttataaactggtcgtttttataggatgaaagagacttacataatagagattctcaacctaaaaataaattgtgagtattgcaatataatattgttgttaaagttatagattttgtagttagagaaaccacagtatgattctggctctgctactgccttgccctgtaagtctgggcaagttgcttagacttgctcagccacagtttatttaaaagtgaggacagccacaaggttgtttcaagttttaagtgagataatggcatatagtaagcccttaatagatgttagctattattagtagtgttcatagattctataaccaaaatttcaaatttataatggaacaagtgatatttataggttaaatcattctacagatatttattaaacaatgattatgtgctgcgtactcactgtgctagatgctataatcaaagtaggaacaaatcagacctcgacctcctggagactgaaggtgcataatttgcatctgatttatattaataattgatgaattagtaaacagttcctgtactgacatatgtgctgccagcctaatgggttacttagttatcctcattgaccatcagcataccaaaaagactaggatagtttaaaattgtttttcttcaaaatcaagtttaatggggttcttatttaatatttcaaagtacataatatattcacatggttcaaaatgcaaaaagtggaaacagtcataagttgacaattctctttcgcattgcttagttctcaacttaccccacaaaagtaaccactgttctcagtgtgtatacatattcttttggaacattaaaaaaattgacatcacagttgtacatatttctgtggtacatgtgatattttaatacttgtatacattgtgtaacaatcaaatcagggtaattgggatatccatcacctccaacatttatcttttctttgtgttgggaacattacagttcttctctctagctattttgaaatatacaataaattgttcttaactgtaattttcctgttatcctatactagaacttattccttctaggatttttttttagttgtcttgtgttcaagaattagcacaatttatcattgtgctagactctttaatcacagtaaaacactagacttgtgtatttgcttcctaataaacgagcagcgctattaatatagaaaaaagaccgttgaattaaaaatagaagtctttaaaaattctagtagtacattcatcattgaaagactttaattatcatctgattttcctttctatgccatttggaattataaatggtaattttttctttgtgtggcactaccaaaaagtgcaatgtttgggaaaataagttatttcacattgaacagtagttagacattgtgctcagtttagataggattacttgaagcttggttttgatttgtcagtttctttagcttatacctgccattttgtagtaacagtcaattcagtattatattattctcagattttattattttatgctattttttacatgaacaattagtatttaatggtcctttgtaaagttttttctcaaaatgtagtgttaatttgtctgcatgtttaaagtttattggaaaagttattttgcctattcagagcgtaaaacttttagtacattttgttttataagtataggataccatgatgatccctggggaatctgattttttttaacagacaagaggttcccagttttcatttttaaatcaagttgctatggggctagcatctttgtttgcttaattttaatcacaattaccatgacaaaacttatttatttagctaatgcctaacagtgtcaaatgtatactgctggaaactggactaatttctatctgactaataaaaatcccaaataaaaatggtacatttttattttaaatggaaaaagattagtttctgaatataaattgagtttttaagtttttctttttggttaattaaagtctactctgatgcttttttgttaattttctttaatatccatatctcctaaatttaatatgcagttctaaaataaagacaagtcagctgggtgtggtggttcatgcctgtaatcccagcactttgggaaactgagcctggcagatcgcttgagcccaggagtttaagaccagtttgggcaacatggtgagaccctgtctctacggattttatactttttttttttttgaaatgggatctcactgtattgcccaggctggttttgaactcctgggctcaaatactcctcctgcctggtactacaggcattcaccaccccacccagctgattttgtacttcttgacaggaaaagaaaaatgaacaagaaattccttaatgcatattttaagtgctgctttaaaattttatcagtacagctttagaacatcacgctagataatagtgttgtactgttatttcctttttaatttattaagaaaaaggaagatgcaggggaatgaatctttattgaactttcctggcctgttcaaggaatagtaaataaaccaacttagctggaggggagtggagagggccttgtaggccattgttaaaaccttaggcttttactcaggttgagatgagaagtcactggagagtgttgaacaaagaagtgacattatgtgacttaagctttaagagggttgctttgctctgttgagaatagattctacctgggcaagaaaggaagcaaagaatatttaggaggctttggtaatgatttgggcaagagagcatgatggcttaggctagagtgggagcaatgaagatatgataaatgtttatattctgtacatattatgaaagtagagataacaggattttccagtgtgatgtgtgagaaagaggggagttatatttttggcctaagccaaggtaatgatgggattcccactaactgagatgagggaagactatggggaggaaggtcagttcagttttggacatgttaagttcaaggtatctattagacagccaactggagatgttgagtaggctattggatatataattcttcagctcagagaagaagatacatatacatttgtgagtcattagcttattgaaggtatttacacccacaaagctaagtgaaatagaaaagagaagaggtccaagggcagtgggggtcacagcaatgttaaaacatcaaaatggtaagtaagactcagagaggagactgagaaatagtgtccagtgaattagaaagaaatctggagaatgtaatactccagaagccaagtgagaaaaataatttcagggaggaaagagtgttagattgtgtcaaatgatgatggatcagaagtatgaagagtgagacttgaccattggttttaacaacattagagacctcatcaagaacagatttaatgaaaaagtgccaaaacctgattagagtcaacttaccagagaatgaaaggagaagaactagaaacaaccaataaagacaactcttttgaagaattttacagagaaatgagatagtggccgggtgaaagtatgatcatgataaaggggtgtgtgtgtgtaatgaatgtgagatgtgagaaactgcagcatgtttataatctaattggaatgatttagtagagaaaaaatgatgatgagagagagaattgctgctgaaatatcttcaggtagggaagagggaatcgaatctactacatttatggaaaagtagctgtaggctggagcacagacagttcatctgttgtgacagaatgaaatgccaggtatatggatacagatattagaaggtaatatgatgatttgataaataaaaacaaggtctaggtagatactttccatttttgaaagaaatgtgttataaaaattattaccattttagcatagtggaaaggaatgaaattggagggagataaacctgggtttagattttagctctgccaattactagctgacatgtggcagaacttagttacaatgcccctgtattatttagggacccagcaagaaataaaattcactaaaaagtggttcaaataaaaacactttaatgaagagtctactttgagagaatgaacagagttaaggaatgggcaagatatggtaaggcaactagaaactagcaattatggaaagctgttacctcacctggggctgaagaggcaagagtggacatggtgtttttagtttagtgattgccaaaggtatgaaggaaggaccagctagtaagagctatagttgtggaggaacacagctgttgccagagacaatggtacataggtaaggaagcagcagagaagaaataaccttgatctctctctactcctcaactctatttttctgctattgacctccattggctaaatgtaagcagaaaccagctgcaaggcttcttaggtgttgcagaatatagggttcactctccctagggtccagagaagggcaaaagatggatgtggagacaaatgctgagtaatcagtagaatcactaagcctcaacttctccatatataaaatgaggctaccgcaaagttgctgtgatgttacatgtactgccaagcactgctacattgctagcatatagtactgtttattaaatgacaaatataagatgctacagcataatggttggtccttaaagctttggaattaggcagatctagatttaagttctgtccgtcacttactaatcatgagattttgggaagtctttgttttgtcatctgtaaaatggggaaataaggcttaccacagagaattctaataaagatgaaaagggacagtgtatattaagtgcctaatatagtgctggtacacagcatgcagtttaagttaccatgaccatcataatattatatgactagaaagaatagtaaatgacatcagtttccaagtaatactagtctcctacccctccccctccccccacactttttttttctgcttctcagtttttctgaatagggttatttctttgttacatagggttcaaggttaatatctttgcactttaaacaattaggaaatatagctttagttagtttaactttttggctattcatttattttgtttttgatttatgttcgctaaacacacacaaagagttaagtggatttttttattaggcctaagttggaaggcatagaaaaagttggaaacactgaattcagtcagtttcattagcatagatttatatatgaagctcaagtaaaatgtcatcaagaaatgggagaatataggatgctgtaacagttaattcagagccgtactataataagtattctttttaaatttcacataaatataacagttctgtaagcttgatttgagggcacatacatgtttttctttttggctacatagagaacaatgaaataaagcctcattgacgtaattgaacctgataacatctcctggttgtactgctgatgtttcactgtggttttggtggttttgtagagctccgtagagcgtgttagacttaaaaacatattcaaacagaaacttttatcaggattcaactttttaaccataaagaaaaaatgaatgtaaataaaggtgcagtcttgggtacacctagatcaacttaaaaatgtttaatagtatatattacttagagaaattactgttccttaattagttttgaacaaataaccacagtatgaaaagaaataataatttctggtattgtattatatattagcacagaaggaaagaggtaaatataataatggaagctcctaaaaacagcaagttaaaattttatgctttcattaaatgatgtcttatagtttgatagaactacatgtttaaaacataccatagcactataactttttgttttaaactgggattaaaaatttaattttatttattttatatatatatttataaaattcttatatttaagttatttacaagatctactttggtattgggtttagatgcctaaaactttgctgacttggaaacaatgtgtatcagagcatttactgtctacttggaagtaaaattttaaaagagctacattttattatataggaggaatgagtgcttgaaccagtatttcttaaaagttttaatatacatgtaccgccaactatgcattccgtatgcgtggtagctacccaccaacttaaggtaaatgtataaaaaagaattaatcacaatttttgaaaactaaaaaattaaaatattttatatcagtgtatatttacaatattaaaggtatctctgtttagctcaatgttgagtaaataggctgcttgttgtaggttcattgtatatcgtcatattcttttctcatctctatttctcttaacttggaaaaatccaaccaaaattataatttatgaggacagtcagcaggggttttttggctgttggttctgaatactcaggttaaacatggactccagaattaagagattgctcactgaagactctttcaaggctgagtcacttgctaagttgatggacattatcatacttgaaagtttaagaaatagaggcttttgcattttattgaaaaaagctctttttgctctttatattttatatttacttttaaatattttatttgctcagtttttccaaagcacactgaaaagatgtatactctgtatccaaaaattgagtgcatttacatttatgctatttctttaacattgaactcagcataatgtattttaaccaccagcctctttctgtgaaaacaaacaaacaaacaaaaaaaaaacagggtatatagatttgcagttagtgtagtactcattgcttagcaaggctttttcttgatgtgcagacaactgattttttctctcaggactgatttcatcacatatttcccagtctatatcatagtttacaaaacaaatattaagtaggaaaaaaaatcatgttttgtagtatgaatttttcagaggtaaacacaaaaacttgtctgctattcttcctcaagtgtattacacatataccaagagctgatttggctttgcacttcagtgcatttatcaagcagtaaagtaaaatatctggtttttctttcagcataatatttatcgtttgtgtggctgagagttttataaatctctcagcaatagtctatcttttttatatgcttttgctaggaggagcacagaatctgaatggtgcctgtgtagtttttgtctcttttaggaacaaaaatcttcagtttcatatatgaaagcattttgtgcttgttctagaaagattctgttcatttaccaaagaggtttttatgttttgtttgaaaactttccatagcttcatgtcattatttgataaagtttcaaagtagacaacatccagaagaatatagggtaaatgaattaccagtcagaaagaaatccagcttttagatagttgctattgtatgtgctagtaaaatttttgtttttatctctttgtgtggtattatcacatgcacagatttatattgtttgcattagagtcctattcttgatttaggttcaacatttattccgagctatttatgttaccctatttttatcaatatcttaggctttaaaaaccaattttgagccatttatttattgattggggagtataatgcaacacaatgaaaataatgcaaatttaaaagatataaataatattcaaatgatgtgaaaatacttcaggtaagatgatttgttctcttttagaataatgcaggtcttagagaaccttttcagcttttaagaatataagtttttaagataataatgagatttctgcggaaatcaaaattaaccttatagttcacaattatgaaatatatgcaaactaagttgtttcctttttccctctaaatattctgggacaatgaggaacaactagtgattgacagatcataatttgataaataatggctaatattctattacaatttcctagtttaaaattttatgtttttaaaaatatcatatatatatttttttcgtgtatacatatatgtaatctaatactacggagacacttagcagtattttcattaagtatttgctctttgcatatttctcactttattctgtcattagttctcccactgttcaggatcattcctatcaagtacaagcatgctttagaacctaccatgttaaaaaaaaaagtattattcccacatttttttctgatgattgcttcatttcattcttgcctttacagcacagtttttcaaaagagttttctctagtcactttgtctacttccttaccttcctaaattcatcttaacttttactaaagctgaacaaatatttatgaaatatgtgtaaagtacagagactaaagaaacagacaccatcaacccaccattactggtgtttttgaacattaccattaacattgaagttccctgtatgtcactcctggatctggttcacttctttttcttttagagataatcaccatcctgaatttctttacagtttaccataagtatttctaataagcatatcgcaatgtgtatttcatgttaaatgagtgaaggtatactgtatgtatctgtctgtgacttgtttttcttgttcaacattatgtttctgagatccatccatatacgatgtagctgtatgtacttcattcattttcactcctatactccattgtatgaatacatcaaaatttttctattttattgttgatgaacatttgggttgtatctagttttttgctaccctaagctgcacagctatgtgcattcttcctgtctccttctgtcaaactgtagcaaaggaccaagcttttgggtttttccctgatctgttgtggattgatgcttttgtaaaatacactaaaaatgtctcaccattgtcaaattgctataaaaatatataaacctttactctgaatttctgtatttatcttattatggaccacactttgaatactgctctaagatgtgtacctagctgtggaattcctgggtcattcatcttctattacttatggagaaaattgttttctcaaaatcactaatgtgctacttgctcaaattacgcagaaggcagtctgctagctctttgtggctttctgtgtatctgctttcaattcctaatatgaaggggatttcacagtaagacctgctgctttagggtaacatagttttcatcctagagaaagtgactgcaaataagattgggctttgcttaagaattgattcaaagccaatctagcaagcacaagtgagagaaaactatgataatgggataaagggccaggaagagtgaatttattgagggagatggtctgtaatattgtaatactacaatattgtaatgtacaatattgagggagatggtctgcaatattgtaaaaatataatattgaaatattgtaatacaaaatgctacagtagagagatctaaagagagcaagcagagaaaaaagaagcattgtacatagtaagatttttagagacctttaagagtccagttaaaatagggcatacattccttctcatattagcagccttccttctgcataggcagcctttaattgtctaaatgcattagagaactttcacaaaatataagctaagatgagattgctcttataagcaagcagcaggactactttttatcagtgtttctccaccgtattttgattacaactccgaatccagggatatatatatatatatatttatattgtatatacatatgtaaaatatatgtacatatattaaatattatatatacatatattatatatatgtttccataatcatctcccccttcatgtaattttcataccaaagatgtacagtatatctgtttgtatactgtagcctttggagggctacgaaccattttaattttcaagattttttttttttttttgccccaagaaccagctaccacttgcttggaagtgatagcaccactgttgagagtatatcacatgaatacaaacatggctcttggcattagagtacaaatatttaaaaaggtaatgtttatttaatcatgtaggtcaatgaagtggggaaggcagactactcaatgttaagaaaccatcctaatgaaaagtatacttgagttagccagaaatcaacttctacttagagttgtgagtcagggaaataaggtatacaagtatttgtctctgtttgatggtattattgtgggaaaagtgtagaaatgtggatcagatgatagtacagttaaaaaagttagcagaccaagaatgccaattagttcattgatgcctatctcataggtgatttttagtgatatatcgtatggctctgttttcactcctgtctattctagacatctattcgtgaacttaagaaaacatcagatttatagatgttatgataatgggaggaatggagaatagggtagttgacattctcaatctccaaagaagctgacaggctaaaataagggcagaagtaaagtattgcagttgggtctaaaaagccatatttataagaatagcatggaggaaaatggatcataacaatatcatgtataaaagaaacttagggattttaggttatgttaatcttaaggagcattttaggaagctattaacatcttaatttgcaataattagtgtctcttgaatctagattatatgctgattaaatcacaacctgaaataattatatcaggaccacatttaggaccatataaaatactgcttaaatttaatgagtctgttatatatatggtatactttgcatgcagttatatcagagccattttgtgggcactggttcacaagtcttctgagtgattgtactgtgtctgaattttctttgggaagaaatagatttttcctcagtggtaagaaagaaattacgttctgcaaggatattgatgaggagatggtgataatgataattgacagttttttgagtgattaaacatgggtgtattatgtaaaatatgagtcagcaaactgtagtccactgaccaaatgctgccagcagactgtttttgtatcacctttgagctaataattttttttgcattttaaagggttataaaacaaaaacaaaaagcaaagaatatgccatagagaccttatgtagccagcaaagcaccaaataagatcttttgcaaccagaaaacttaagcctgaaggacaaaaaacaacacaaatagttcaatatatagaaattatgagattatattacagattaactgggctcatattcaatacaggttcaaagctatgtacaaaatggctattagaatgaattatttaagcaaaagaagacctatttaactcagtaaatgtcaaagaaatttaggattgatgataggtagcagttatagcttcctaaattaaagttaattttatctccttgggcatagtgactactatattgggttgggaagcagccaaaaagcttgttaggaagaagggcaggaaaaaaactagtctgggactaaagttaccattgataagctaggctatcaaggagacagacaggaaaacaatcactaattatgtgcatatcaaaaggggtatgtgctgcttttgataagtctattcttttatacttaatctaaccccaaggacaacaagcttttcaaaatgtttttgacagaagtaccttattggtaggaaaatagcatcacccatcacccatgatgagcctttggagatggtgggtaggcagagaatatctgatgatatgtaatttttcttttattttttgtgacttaatgtgattatggatttatattttcctttttgtggtagtatttgaaggttaatatggcttgttttagttactttattgtgataattctttattcttttgatttctcaattatagattatattaatgaaatattctgtcgagataatttttattttcaccattccaatatctcttccagattttgagctatattagataattataattgaaaatgctgaattttgtctttacatatacttttttgtttatttttggtttgtaaccaagtgaatttttttttctagatgattctttgggattgggacttaaaacaatggtataagcctcattatcaagtaagtataattaatatctgtgatgaatatctaaataatatctgtgatcactaaataatatctgtgatgcaacttttgacacttaaagttacactcacaatatttctgtgccataagattttctttaactaaactaataagttaactagaaccttcattgaggtagattttttaaaaatatattttaattataagggaaaaagaaaatgataaaaacaaaatttatataaattgttatgaaaaatattgctaatataatctgggctcagaatcaactaatatttctatattaaggataagatttttttcttttctgatgtggaccactgttctataaaggggaaaaaatagatggaaggccatatctgagacaaagcaaagcagttggcaacatattttattagggaagtaaagatatccaactttcattttttggtaaactttttatcaaattataacatacatgcaggaaagtgtacagctcaattttcagaagttaaacatcccatgtaactggtactgatatgaagaaatagaatgtttccagtatctcagaagcctcacatatgcccaattccagtcattacctatatccccaaagataaatcctatccgacttctaataactagttttgctaatttttgaactttatatatacacaaatggaataatatgtgtacttttttaggattaattttttgaacacctaagtaatatatgtttatatcagataaaatgaaaatagaagtatttaatataaggagaaaaaaggaaaatcactcataaaacatcaagcaataactgtgttaacttttgatgtctatctttattgatctttcccattatgctaaatttacttaataattctaatagcttatttgaagattctttgagtcttgacgtacacaaaaatgttatctatgaataaagacagatttatttatttatttcaaaacctatgccttttatttctttttctcatgttattgtactttctaggaccttcaacgcagtgttgaatggaagtggtatgagtaggcagccttgtttttcttcatgaactcagggaaaaaatgttcaacatatcaccactaatgttttttgtagataccctttagcagattaaggaagttttattctaattctagtttactaaggactttttttctcttaagttatgagtgggtatataattttatcagatgctttttctgcatctattcaaatgattcgagatttttttctaattattctactaatgtggtgaattacattgtttatgtttgttaaaccatccctgtattcccagaataaagtaaatttgatcaagatgtattttgtttaaatatttatcactagattctatttgttaatgttttgtttagaaattttgaatttgtgtttatgagagagtgttggcctataaattcttacttttcataatgttcttggcattatattggtatcacggttaccaagaaccttgatatcaagataaaataaggtgagatatttaccctttctattacctcgaaaagtttgggtaagattaaaaattggtattatttcctcctttaatgtttggaagaatgctctggtgaagctatctcaccttgaagaattattttgtggtcaaattttaagttatggattcaatttctttaatagttttagtatcatttagattttccatcttttcttctaacaattgagttacttgtgtttttctaggaattcctttttttgttgttgttccttctggcatttgtgagactgctgaaagccctattttaatttcaaaatagaaatctttttgaggatttctacttggtttatctctctcttagccactgtttataaattggcaaatacctttagaggaaaagcaggtctgaatttaagctcactactttgtttttctcatcactttgggatcttgtttggcaccccctgtcttcatagctctgaactccaatttcggtctcccagccccttgggactatagatctctactctgttttctggcctcttttgtgcttctcatcctctctgctctgtgccagttatgaatcagcagaaaattcctagagggaaaagagtagcacagaatgttggatttcttttaatcttttctcttaattctgggttcttggccttttatgccctggctgtttggttgtgttttgatgccttgaaatgtatgctatttatattttatttcagcttttctagttgttctagacagaagagttggtctgatacaaaccagtccctcttagctggaaaattaggcaagcctcttaagacactctgaacctattccctcacctacaaattgagaataataccagttccctcaaagggctaattaatatgtgcctggtacttaatacaaatgtgggccaatattatataaatttcaatagtaataaatactaatctgaacttgaagtataagacaggaatgagcatttttttctttaaaaggccagagagtaagtattttagcatttgctggaaacatatgaccattgctaccttttgccgtccccagtgcttctcattgcctcctttgtcctcttctccctcccactcctcttctttttcaataaccatttaaaacataaaaactattcttaactttctgttcaacaatcaagattttgctaaatataagtgaatggaaaataggaatttaagttcagcttttaaaattgtggcaaataatttgaatattcaatttgatctgccataagttatcatgtcactctcttgctcatttctctcgtttcacccagtgtaaaagtctttgtcatgtacgtaaaagaacttacacaacatggttccctcccttactctcttgtacttctctgtctttgtcttctactactttctccttcatttactctgttccagctgcactggcctccttgttattccccaaacaagtcagacaggcttctgactcaggtctttgcacttgctagtctctctgcctgggatgcttatttcccacactttgtcatgtctttacataagcatttccttcttagtgaggcataccccaactatcctctctaaaattgcattgcgttctatcacatctttttcccttaacttactttattttctctttttagcagcttgttcaaaatctattatatacgaccctttattactcatattacttagcttggaatccagtgttctcaaaaatttggtcccaacatgtctttccaacctgtttttcattgctttcttatataatctgtacttcaacaatttcatattccctgtatagcattattttaccacttaaaaattgtattttaccacttttatacttttatttatgctgtgtccattttgtgcagtacacttccccaatacatttttgttttgttttattgtaaacaaatataaatataatcctaccaaatttttagggcccagctcaaatgctaccccttccataaaatttctgttaccatccaaatggaaggtttctatatctcttttgaacgctaatgccattttgtctgtatatataatttttttctttttttgagacgaagtttctctcttgttgcccaggctggagtgcagtggcatgatctcggctcaccgcaacctccagctccctggttcaagcgattctcctgcctcagcctccggagtagctgggattacaggcatgtgccaccacacctggctaattttgtatttttagtagagatgggatttctccatgttggtcaggctggtcttgaactcccgacctcaggtgatctgcccacctcggcctcccaaagtgctgggattacaggggtaagagaccacacttggccattttgtctgtatttttatctcttcactttctgttaataataacagtactatctttgcctttagttatatatactatactttatatgctctgcatgtgttaccatatgtaactctctcttttcctccttgctaagtacagttattaagtctggaaataatgtaagaggcaatcaagtgagaactacaaaaaatagaaagaggaaggcagactggctagggaccctagtacaggaaaaacaacacagtgacagagtctcttatgacccacacccaacagcaaacctggtctaggcccccactctcaacctagcaacataaggtgacacaggtaggcttattctttccccagattaaacaagagccctgccaacactaggcaagtctggtggctctagcaagggggaattgatttggaaccactggcaatcagtgaccagggagaagcattctccttccctcctgggcatgagactccccttccccactgacagacactgggtggccagtgtgcctggcaagggggatgtcctcacaaatgcctagcccagaaagtgatctttgttcctgtcacctggagactcctttctctcccctaaaggtaccagatgacccaacctgaggaagctctctttccccctactgtaaggcaccagtgtggactgtggactagtgggaacccaacgggcaccaaatgctagatgacgagttagtgggtgcagcgcaccagcatggcacatgtatacatatgtaactaacctgcacaatgtgcacatgtaccctaaaacttaaagtataattaaaaaataataataataatagtaataataaaaaaaaaagaaaaaaaaattcagacacacctaaatgattgtgaatgctttgaaaattgtcatccaaaccacagcccacaaaagtaggccaggacctgtgtgataaacctaaatggggatatgccttctaatggcaaagatttctgtaggacccagagtcttgtaagttatagtgaaaatattgaggataaaataaaaaatcacccatcataccaaaaccaagaaaatcacaacttgaataagaaaaaggaatgacaacactaagatgaatcagatttggaattatctggcaaggatttttaaagcaaacatcataaaaatgctctaacaaataattacaaagtatcttgaaacaaatggaaaaagaaagaaaatattagcaaaagaaatataaattataaagaagaaacaaatggaaagtatagagctgaaaaatacaataatagaaatttaaaattactggatgggatgaataacagtggagatgacagtaggatagaatctgtgagcttaagcatagatcaatagaatttagccaattttacaacatagaggaaacagaaacaaaatcagcaagccttagggacctattgggaagtaacaaagaaccaacatttgtattgctcgtgtttgagaaggagaaagggggtggcattgaaagagtatctgaagaagtaatggctgaaaacttcccagatttagccaaaaacttaatcctacagattcaagaagctttctgaaccccaaatagtatcaaccccctcaaaatctactctcagacatgtcataattaaacttatgaaagctaaagacaaagaaaatatcttaaaaagcatccagagagaaacaacacataacctataggggaacaccaattcaagtaatagcagatttctcatttaaaaccatgaagcccagaaggaagtggcagaacacttttgaagaggtggaagaaaatggctgtaaagtctatatccagcaaaagtattctttaagaatgaaggggaggaggttccaagatggctgaataggaacagctccagtctacagctcccagcatgagtgatgcagaagatgggtgatttctgcatttccaaatgaggtactgggttcatctctctggggcttgtcagacatggatgcaggacagtaggtgcaacccatggactgtgagccaaagcagggtgaggcatcacctcacctgggaagcgcaaggggtcggggaattctttttcctagccaagggaagccatgacagacggcacctggaaaatcgggcaactcccactgcgcttttccacctaatactgcgcttttccaacggtcttagcaaacggcacaccaggagattatgtcctgtgcctggctcggggggttccacacccacggaacctcgctcattgctagcacagcagtctaagatggaactgcaaagcagcagcgaggctgggggaggggtgcccaccattgctgaggcttgagtaggtaaacaaagcagccctgaagctcaaaatgggtggagcccaccacagctcaaggagtcctgccggcctctgtagactccacctctgggggcagggcatagctgaacgaaaggcagcaaaaacttctgcagacttaaatgtccctgtctgacagcgttgaagagaggagtggttctcccagcacggagtttgagatctaagaatggacagactgcctcctcaagagggtccctgacccccgagtagcctaactgggaggcatctcccagtaggggctgactgacgcctcatacggccgggcgcccctctgagacgaagcttccagaggaacgatcaggcagcaacatttgcctttctgcaatatttgcagttctgcagtctgcactggtgatatccaggcaaagagtgtctggagtggacctccagcaaactccaacagacctgcagctgaggttcctgactgttagaaggaaaactaacaaacagaaagaacattcacaccagaaccccgtctgacgtcaccatcatcaaagaccaaaggtagataaaaccacaaagatggggagaaaccagagcagaaaagctgaaaattctaaaaatcagagtgccccttctcctccaaaggaacgcagctcctcgccagcaatggaacaaagctggacggagaatgactttgacgagttgagagaagaaggcttcagatgattggtaataacaaacttctgtgagctgaaggagaatgttcgaacccatcgcaaagaagccaaaaaccttgaaaaaagattagacgaatggctaactaaaataaacagtgtatagaagactttaaatgacctgttggagctgaacaccatggcatgagaactgcgtgacacatgcacaagcttcagtagccgattcgatcaagtagaagaaagggtgtcagtgattgaagatcagatgaatgaaatgaagcgagaagagaaatttagagaaaaaagaaagaaatgagcaaagcctccaagaaatatgggactatatgaaaagaccaaatctacgtctgatgggtgtacctgaaagtgacggggagaatggaaccaagttggaaaacactcttcaggatattatccaggagaacttccccaacctagcaaggaaggccaacattcaaattcaggaaatacagagaacaccacaaagatactcctcgagaagagcaactccaaaacacataattgtcagattcaccaaagttgaaataaaggaaaaaatgttaagggcagccagagagaaaggtcgggttacccacaaagggaagcccatcagactaacagcggatctctcggcagaaactctacaagccaggagagagtggggtccaatattcagtactcttcaacaaaagaattttcaacccagaatttcatatccatcccaactaagcttcataagtgaaggagaaataaaatcctttacagacaagcaaatgctgagagattttgtcaccaccaggcctgccttacaagagctcctgaaggaagcactaaacatggaaaggaacaactgctaccagccactgcaaaaacatgccaaattgtaaagaccatcgatgctaggaagaaactgcaccaagtaacaagcaaaataaccagctaacatcataatgacaggatcaaattcacacataacaatattaaccttaaatgtaaatggattaaatgctccaattaaaagacacagactggcaaattggatagagtaaagacccatcagtgtgctgtattcaggagacccatctcacgtgcagagacacgcataggctcaaaataaagggatggaggaagatctaccaagcaaatggaaaaaaaaaaaaaaagcaggggttgcaatcctagtctctgataaaacagactttaaaccaacaaagatcagaagagacaaggccattatataatggtaaagggatcaattcaacaagaagagctaactatcctaaatatatatgcacccaatataggagcacccagattcataaagcaagtccttagagacctacaaagagacttagactcccacacaataataatgggagactttaacaccccactgtcaacattagacagatcagtgagacagaaagttcacaaggatatccaagaagttaactcagctctgcaccaagcgaacctaatagacatctacagaacactccaccccaaatcaacagaatatacattcttctcagcaccacattgcacttattccaaaattgaccacatagttggaagtaaagcactcctcagcaaatgtaaaagaacagaaattataacaaactgtctctcagaccacagtgcagtcaaactggaactcaggattaagaaactcactaaaaaccactcaagtacatggaaactgaacaacctgctcctgagtgactaatgggtaaataacaaaatgaaggcagaaataaagatggtctgtgaaaccaacgagaacaaagacacaacataccagaatctctgggacacatttaaagtagtgtgtagagggaaatttatagcactaaatgcccacaagagaaagcaggaaagatctaaaattgacaccctaatatcacaattaaaagaacaagagaagcaagagcaaacacattcaaaagctagcagaaggcaagaaataactaagatcagagcagaactgaaggagatagagacacaaaaaacccttcaaaaaatcaatgaatccaggagctggttttctgagaagatcaacaaaattgatagactgctagcaagactaataaagaagaaaagagaagaatcaaatagacgtaatgaaaaatgataaaggggatatcaccaccaatcctacagagatacaaactaccatctgagaatactgtaaacacccctaagcaaataaactagaaaatctagaagaaatggataaattcctcgacacatacaccctcccaagactaaacaggaagaagttgaatttctgaatagactaataacaggctgtgaaattgaggcaataattaagagcctaccaaccaaaaaaagtccaggaccagacggagtcacagctgaattctaccagaggtacaaagaggagctggtactgttccttctgaaactattccaatcaatagaaaaagagggaatcctccctaactgattttatgaggccagcagcatcctgataccaaagcctgccagagacacaacaaaaaataattttagaccagtatccctgatgaacatcgatgcaaaaatcctgaataaaatactggcaaaccgaatccagcagcacatcaaaaagcttatccaccatgatcaagtgcgcttcatccctgggatgcaaggctggttcaacatacacaaatcaataaatgtaatccatgatataaagagaaccaaagacaaaaaccacatgattatctcaatagatgcagaaaaggcctttgacaaaattcagcagcccttcatgctaaaaactctcaataaattaggtattgatgggatgtatctcaaaataataagagctatgtatgacaaacccacagccaatatcatactgaatgggcaaaaactggaagcattccctttgaaaaacagcacaagacaggggtgcctctctctcaccactcctgttcaacatagtgttggaagttctggtcagggcagtcaggcaggagaaagaaataaaaggtattcagttaggaaaagaggaagtcaaattgtccctgtttgcagatgacatgattgtatatctagaaaaccccatcatgtcagccccaaatctccttaagctgataagcaacttcagcaaagtctcaggatacaaaagcaatgtgcagaaatcacaagcattcttatacaccattaacagacaaacagccaaatcatgagtgaactcccattcatgatggcttcaaagagaataaaatacctaggaatccaacttgtgagggatgtgaaggacctcttcaaggagaactacaaaccactgctcaacgaagtaaaagaggacacaaacaagtgacaatactgcccaaagtcatttatagattcaatgccatccccaacaagctagcattgactttcttcacagaattggaaaaaactacttgaaagttcatgtggaaccaaaaaagagcccacattgccaagacaatcctaagccaaaagaacaaagctggaggcatcatgctatctgacttcaaactatactgcaagcctacagtaaccaaaacagcatggtactggtaccaaaacagagatatagaccaatggaacagaacagagtcctcagaaatagtaccacacatccacaaccatccagtctttgacaaacctgataaaaacaagaaatagggaaaggattgcctatttaataaatggtattgagaaaactggctagccatatgtagaaagctttaactggatcccttacttacaccttatacaaaaattaattcaagatggattaaagacttaaacgttagacctaaaaccgtaaaaaccctagaagaaaacctaggcaataccattcaagacataggcatgggcaaggacttcatggctaaaacaccaaaagcaatggcaacaaaagccaaagttgacaaatgggatctaattaaactaaagagcttctgcacagcaaaagaaactaccatcagaatgaacaggcaacctacagaatgggagaaaattttcgcactctatccatctgacaaaagggctaatatccagaatctacaaggaacttaaacaaatttacaagaaaaaaatcaaacaaccccatcaaaaagtgagcaaaggatatgaacagacacttctcgaaagaagacatttatgcagccaacagacacttgaatgctcatcatcactggccatcagagaaatgcaaatcaaaaccacaatgagataccatctcacaccagttagaatggtgatcattaaaaagtcagggaacaacaggtgctggagaggatgtagagaaataggaacacttttacactgttggtgggactgtaaactagttcaaccattgtggaagacagtatggtgattgctgaaggatctggaactagaaataccatttgacccagccatcccattactgggtatatacccaaaggatgataaatcatgctgctataaagacacatgcacatgtatgtttattgcggcactattcacaatagcaaagacttggaaccaacccagatgtccatcagtgatagactggattaagaaaaagtggtacatatacaccatggaatactatgcagccataaaaatggatgagttcatgtcctttgtagggacatggatgaagctggaaaccatcattctgagcaagctatcgcaaggacagaaaaccaaacaccgcatgttcttactcataggtgggaattggatagtgagaacacttggacacaggaaggggaacatcacacaccggggcttgtagtggggtgggggagtggggagggatagctagcattgggagatatacctgatgtaaatgaggagttgatgggtgcagcacaccagcatggcacatgtatacatatgtaacaaacctgcacattgtgcacatgtaccctagaacacaaaatataataataaaaaaaaagaatgaaggggaaaacattgtgaaatgaaggaaaacaaaagaatctgtcagtaagagatttaccttgcaagaaagacaaaaggaagttctttaaaccaggcgtcaccaaccagtaccggtctgtggcctgttaggaactgggccacatagccggagatgagcagtgggcagatgagcattaccacctgagctctgcctcttgtcagatcagccaccacattagattctcataggagcacaaatcctatggtgaactgcacatgcaagggatttggggttgtacgctccttatgagaatctaaggcctgatgatctgtggtgaacagtttcattctgaaaccatctcctcgcacccctacccagtctgtggaaaaattgtgttccacgaaacctgtccctgatgccaaaaaggttagggaacccctgctttaaacagaaaggaaattataaaagaaggactcttgaagtaacaggaaggaagaaagaacaatgaaacaggaagaaatagtgggagaatgcaatagactatccttcttgtgagtttcatgaatcatatttgatgattgcaacaaaaattataacatcatctgatactcaagacaagacaattatacttaaaagtaagcaaggtagagacctaactagtagtaaggttttcacacttcactcaaagtggtaaaatgttgataccagtagacggtgataagtcacatatgtacattgtattgccaagggcaaccgctaagaaaactttatatagtaatacactcagaaactctataaattaatcaagatggaatcataaaaatattctaataaccccagaaaagcaagaaaaaacagaggaacaaggaacagaagaaacaaacacaaaacaaataataaaacagcaaacttatggcctgacagaagtatttaccttaaaaggatacaatatgaagaaaagtaaaaattgaccatgaaaaaaagatttgtctatgaaaatgatttttttttacatgaggtattcctgttgtcattggagatatttatgagtagattctaattaccttgtattgttaaagtgaaagtcacactgtactctcagtaaatttgtgatttgttctttcctaatttcaacagtttttaaacagtattgaggaaaggttacttgcaaacaaaaattgtttttgtgtgtgttccatttgaatatgtaaatattataaggaacatttagaatcacaataatcagagaattcagattaaaacagcaattagaggtttttttgcctatcagatagggattaattaaattcatagttgctaattgtaatgggatatggaaaaataggtgctgttatatacaattagaagtgtagatttgatcaacatattctaaggcagttttagaggaatgaccttattttaacatgttaatttgcattcagcaattcagattatgggaagctgtgtataggaaatatgcttaattgttcacagtaacatatatagacaggtgtttattttagtggtatttgcaggggagaaaggctagaaatagttgggctatgccctggtatcaggaaatgttttaaagtgaaaactaatacatattaacacttcataagaaaaaaaattccgcaaagagcagacattatttagctagcttggtgtaatgttcataatatttctcagttccaaaatgtattggggatactttaataaacagttttgttgtgaactcattaatttgaataattattaattgcaaacatacccaaatgtaagttcaaggtacaacaacaacaacaaaaaacaaaagtaacatttaatttactgttctgattactagtccatttatttctatgggtaatcgagttgaacatcatatgtatgttttttcagagagtaaaaatcatctcatgtttacatcggtgacatatttcttctaaattaaaaaatttttttctaccaattttttaaggccttgcctgatgctaccctgtctgtgaggtttttgttaattattcatctttaagttatcgctatctcttttgaactataacatatttttctttatttttatctcatcattttccataatattaatagtaataatactttttgtgctttaaatcatacattatacactgctttatttgctttacatatattatcagatttctcatattagcccataataaggtagacattactatcctgattttacattgaagaaactaaaatattcagaggttaagtaaattactcaaggtcacacaggtaagattaaagtttaggtttcaaattcaggtatgtttgctacaaaaccttgtcactgtgttagactgcctctaaagtgagtaaggtaaatgaaataaatgctttgtatgtttaaaattttgttataaaggaaaggaaataatgaattaatgaaatgttcaaattacagactttaaagtaaatacagatttcgttttatactagtcataaggtaattcagtgttagtagttaataccattaaatataatgtgataatcagctagcgaaaaagaaaaaaattaaagttcacggttatttgctacatatatatatatataaattttaagttagaattataccatttgttatatcatttatgccatgtacaaatgaatgaaaatttcactttttttctttctagaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaaggtcgaaatacagtaatcatctaaccctatttatcaaatttaatgatattttcaaattaactgctcctttaaattctatatagaatacaattttcgtttcaaggatcagacataatattgagctgcttgggatgttagaggcaattataagctcaaataattatagttgagtattcagtttttattttaaatacattgctgtgattagcacttataacaactatgtattattattcttgttaagaagtagagaacagcaagcaaattttgttccaggcttgtacaacaaactagtagtcagatcacgttattgctctattttattctttagaatctaggaattgttcttgttgagccaagaagaaatggtcattatcatattcattttatgaattacatagaattattttaaaatgatttttaagttttttgaaccctgttttcccccttttacacctactgaagattactgtagcccagtaggcattgatttttatatcattagaatagaggattaatttctctttaaaatataaatatttcaaaataggattttctttagaaaataataaatactgttctaaatgggtatgcattatccttgttcagagtgcttttacttgttttatttgactattatcagtatctttgccaatagctaaaatcataaaactttaaaactagaaacattgtagaaattattttactcaaccactttattccagataaggaaactaaccaagagaagacaaaatttatttcagttaattttgtcaattgtaataatgcttatagaacttagaaataggtaaatatagtttttgtagggattttgatcatcagttaattttatcagttgtcagcattagggtttagaaatgttgaaaagttaagcaaacccagttagaggaaaaggatttcagaagtattgatcacaatctggatcattgttatgtgatacttttatttttttaaagtttatgcagtagcacctacattagtcaaaacccaattaattagtacttagttacatgacttcctttttagcactctatcttataagaaagaggttaatcacaagcattcagagggcatagcaataaaccataaataaaataactctaatgtattcttgagttagttttcactctatatgttactctttctttgcattttctgttgatatttgatactcaggatagtaatttttaaaaatagtaattcttaaaatttttaatcagaaatcatattgatatcagtatttagtgtgtagaaaagtgtactggtacattttaggaatattttaaacataatattaattaaacaggatgcctaaatgcctcatttcctgagcattgtagttaatcaaggaaggttattttgggttctggaatctactgatagagtaagtcatataagaaccaggaagtaacccttattccttttctttgtgttctttaaactcgttattagaactctatatcgaatttgtctctccttttggaaaagcatataaaaagcctgttgttacttcagaaaagggcaaaggcatttattgaaaaaacaataggcaaaagggaaaaggaacagacaacttgatataactatcttatacacattaagaacaaagaaagatcatatgaacctaaatgacactcaacaaggatattaacataaaggactttttcactgcaggtctaattaactattaacctttacaaaatcagtgtccttgggaaaactgaaatataagacagatacttatctctgagattgctgcagtgtctgctgatagaggaaattcataagaagcagaaactattatgtaaatctcagtaaaacacttatttataatggtcaaaaatggaatattggtaattgaacatttgggttagttgagaatattttttaaaattagggcaaaatattaatgctaaaggtgttctgtatttaactcagtcatttattcaaacccagaatcctgcagtttctcctgattaacagctaagtaaattctatagcactgtactgaaaatataaaaaatttagaatatagggctgatcatccctgatcctaagattgtcctctgaagttgattttcagggtaaatctttcatatccactttttaaattgccgattgtttcttatgaaacaagtagtaaaatgtacaaaagaaaaagaatctagcttaaattatagagttcagacatattttttagtaggaggaagaggaatagaataacaaaatagagtgtgaaatttggagtaaattgacagattttcagaataaaatgtttcttttttctctgtacatgttaaaaatatactttgtattgatactttcatgtgccatcactaatattacatatatagcatattaaagagtgacattttaaaccattgttaaattattcaacagggactaaataggaatagtttgccaactccacagctgaggagaagctcaggaacttcaggattgctacctgttgaacagtcttcaaggtgggatcgtaataatggcaaaagacctcaccaagaatttggcatttcaaggtaaaatctgcagagccttttaagaaacttgaatcaaatgcatctactttgtttctgtcaataatgtttcaaatagttctggaagcagaaaggaatggttgaagtattttaggtataggacaacatgtgtagtaataatatggtaaaatagagaaactgattattaaagagaagctaatgtgtcttgtcctaaaactttgataggctgggtacaaaatgtgctggatccctgagaacatgagatagtttagggaaatcaggatcaactcaggactggatgctggggaagtttttaaatcgatagaagtggccattacagggttagccaccaatccaatgaatagtatccaaaggtaggtctgcagaattactgacttctgaaaagaggagcacgtttccaaggctcatcacaattgttaggtttaaggtaaccagactttcaaatcctgttcctgctggaggttgagacaactaatatattctatattctgttgaggatttacttggaactgaacaatgctaatcttataaatgaaaggcatcagtaactttaagtaaatgaggctgggaaaatgcaggagctgaaatctcccgaatgtaaatatatacatttaccctgataacaaaggatttaataatacagtactttgtcttttgaaagccaggaaggatactgatccttgtgtgagtttgtcataagttttttctttactcagctttctaattatgttaatataatattggaattggcacaaattctgtgttaaccattttctggtattactgagcatgttttatacttttgagctgtatagtttcacatttgaaacagtagatggcaggattggatcatagctatttgttaaagtttatgttaacagataattagatgattataattttctagattcttaggtggtttattaatttgaatcttgtataatatattcaagcaggtgaactccttttttgtaaaagaaaaattgaatgaagtgatgtctaaaacaggaatggattgaagtatgaagagtactgtacaggaaaatgagcattggtccaaaatttgccatggcctgaacatcatagtcttttttttttttttgtaaaggaagcaggatatagggaagtgaatgatgttaggaacagaaaatgtgacagtatttcttaactatgggtagcattatcttgagaatatagttgggttttaaaaggtatgataaaaatgttttatattttaacctttcatactgatgtaacagcaatgcatttgcagttaaagaaacatttgatacattgagttaaggtcatttttatcctgctgcctcagataattgattacaatagaaacatagttcagagaaaactaatctttaactctgaaaagtgtttattatataaagctaaatgtaggtagattctatgtagtgacttaactcattaaaacaaaatttatgcctcataaaatatttagaaatttggagaataaattaattggtggtattatgtacgtctattttaaagagaccaggctagatgtatcttttctagtttgcagaagctggagcctcttggtaataaatgtctatgtgtactttgcacataggtgggttacgatgggaatatatgaaacatttacaaccactattccttttcagattcaaatctctggatcagtgctgtctaatagaaatttttgcaatgatggaaatagtttatatctgcactgtctaatatggtactccctagctacatgtgactgttaatcatttgaaatgtgtctagcatgactaaggaactgacttttaaatgtgatttaattcttattaatttcattcagatataaagagccatatgtgactgttttgtagacatatgtgacatccatattagtgcagctctagatctttaatgcgtagtgatgttttgttcaggaatctttagactttagtagcacaaaactcatagacttatgactctgaaatcatcttgactttatattatagtactccagaatcgagatctcatatccttgattttgagtcttgagctttggattctgatcacagtttgcctgactgatttcagcatgattccggtgttgaacctctcatttcctgagcctatgcctgataccaggtttctcatcattccagctgcttttttgtctgttactattgttctgcccttatttccccgcacaatgctgctatcctctagtggagtggttgcttacaaaattgatttacttagagacttggtgttatctttgcatcctgttaccttattctacagataacagttgtcagatatctgtctgcattatcttttactctctattcttctcctttatcactgtgcctatactattttatgctttcattactacttacttgggctattgaattagcctcttaattccagtttccagtatccttcttgactttattaatcttccaccttacactagaaatcttccttaaataaaactgtgattgcagttgtccctggttatccctgggggattggttccaggcccctccccttcccatgggtacaaaaatccatggatgcttgagtcctttatataaaatggtgtagtatttacatattctctctacacatcctttcatgtactttaaatcacctccagattatttataatacctaaggcaatgtaaatgctatgtaaagagttgttatactctattttttacttgtatttttttattactgtgttttttttccttgaatatttttgatttggggttggttaaatctgtggatgtagaaacctcacatacagagagctgactatgtatagtttgtctagtcattgcatttttggactctttaccagtcctatagaataacgcccaaattcctagtgtagaatgtgaaacccaattattacctcatgacagagctgcagcccttacttggaaaaagtaaatgaactaacacagatgagcagtctttcaaataatgagaatagaaaaatgatatggaaagctttctaggtaaaaacagtaggcatgtaacttgtttaagactcttccttgatgttttctggtaattttgttcttggtttaacaccatttgaaaattaagctaaattatgtttcaaaataattaaaatacaaacaatgaaatatatataaggtatttggataaaaagtaataccctatttgtgtaaagaataatacaggatttaattttgcttttattcatgctttgcctagagaaaaaaattaagtattataaccctgggagctatgataaaaataatcagaagaaagaaaaccacagggaagaagagttagtcccccattgaacagcgaccctgttcttattgttaagagtttattattgttcatctgttagaggacttgagattttactaattaaggaggccattcctttacaacaccaaaatatgtttccaacatcaccttcctctagtcttctgaaattctagtcaagctgaactatttgatcttctctctgtccatctgtgcacccttttaatttaaaaagcaatttaactggaatagatctcaacttcagttctgtatatccttagttgggctcataaatcaccttataaggataacacctggaggtccttctcccttctccaaggagaagtactcttttcttcctctgaatttccataacacattctcttacggcgcttttcacatttgactttatgtcagccattactactcctctaaagcctgtttaagttctgtaaagagttcgagattgcattaaaatgaatctttgaagacaaatggctgcttaacaagtgtcctgcagaggtatggtatccatatgagattatgacccttaatcttgccttctgcttaagtttcagatctgggatgagatttctgtggtcagaaagttccaggaaaggttgttttctggatttgctgatgataaaattacccatctctgagttctagttttagtacaggttgaatatcccttatctgaaagtcttgggaccagaagtgtttcagatttcaggttttggaatatttgcctatgcataatgttgtatcttggggatacaacccaatattcatttatatttcatatacacatagcctgaacgtgattttatataatattttaaataattttatgcgtgaaacaaagttttgactatattttaactgtgacccatctcatgtggtcaagtgtggaattttccatttgcagagtcatgtttatactcaagaaattttgaattttggagcattttggatttgggatgctcaacctatacttagagttaaaagaagactgaactgctatttttgaactgagtgatgggacccagccttctctgaggtcaaacagcatatattcagggctcacaggtcactctttttgaacaggttttccctggggaaaaaaataggcaagttgtgttcaattaccctgtgggctatcaattatagttacctcctacactaaagagacttgcttttaaacccatgagtcaccatttatcttcaccgctactgtgtaatgaaatctaataactcgttgcctggcaatagtatgtatgttaaattctgtgccttataatttatcagagacttacaccaaggttatattagcaaacttgaccctatttgaaccccagcaattcaagagggctaattgtgtcatcctactcagcttcttaagagaataactctgtaaatttagacatctacagttatcaagtttatacaactgcattgaaactgagttggtacagaccttgttaaggtaatttgtattgactgtctagaagtcagctcttaaaatatagcttagctcagggaccataacttttgacgtctcttgttcgtttgcttttgacaactcattcccaagtgagtagaaaaagaaaaacaaactcaatttcttccaccatactctgacagcacatttctgataccagatgtgtggggatttctccccaccagcaagcaagcgagcaagcaagcaggcaagcaagcaattctgtagtagacataagctaggtgtcctataattcaattatttctttttcttttctttttttttttttttgagacagagtctcactctgttgcccaggctggagtgcagtggcacgatctctgcccactgcagtctctgcctcctgggatcaagcaattcttcctcaacctcctgagtagttgggactacaggcacatgccaccatgcccagctaatttttgtatttttagtagagacggggtttcaccatgttggccaggctggtctcgaactcctgacctcaggtgatctgcctgcctcggcctcccaaagtgctgggattacaggcatgagacaccatgcccagcctaattccattatttctgacaccatctacctggagatagcgtcagatcatactggttaaggactcagtccgacaagactgatctccacttctgatgccaatagcaagcctcaggttattttgcctgtgcttctgaccaaccagctgtaaatcagggttcccacagccccctccctgggttcaggtaatttgctagagcagctcacagaactcaaggaagcatgtttactggcttattacaaataatattttaaaggatacaaatcaacagccagatgaggagatacaaaggacaggtctggaaggggcctgagtacaggagcttctgcccctgtggagttggagtataccaccttccttgcttgtggacatgttcttgttcactttcctggaagcccccacgtgtttggctattcacaagctcctcagacccagtcctttctggatttttataggagcttcattttataggcatgattgagtaaatcattggccattggtgagcaatttaagctttagtccctctcctctctctggaggttgggtagtggggctgaaaacccccatcatctaatcctgtcttggtctttcaagtgactagcctctatcctgaagctacctagaagctgccagccatcagtcaactcattagcatacaaaaagacactttggagatcctcaggagtttaggagttgtatgctaggaaacagggactggactaaaaccaaatatgtatttcacaatatcacaccaagtctgactttaatcaccttcctgccaactattagtagtcattggaactactcgtctgcttgtcttctgctttcttcgtattgatttatgtaatttcattgaggtgtgtatttatctggtgctgggccaggacatgatgggaagattcgggaactaatctgagaacctatcatttgacctgtaactcttaattctaaatagctaaatgaatgtatgatatactgaaattattgaaagaccctggatcaaggtagaagacagtggagcagtgctgtggtgccattctgaaaggagaaatctctctttgtcttgactattaatcatagaatcagggagtgggctttggtagaatacacagatttttctctttttttgttttctttcttttttattttaaactagaagcttttagagtgtgtttgtatgctgtgaatgatatggacaagaagaatatgagatttaattttgtttgcatgtctaagtgtttgaaagctcaattcattatcttattattattattatcattatactttcagttctggggtacatgtgcagaatgtgcagttttgttacataggtatacacgtgccatggtggttcactgcacccatcaacccgtcacctacattagatatttctcctaatgctatccctcctctagtcccccaccccccgacaggccctggtgtgtgatgttcccctccctttgtccatgtgttctcattgttcaactcccacttatgagtgagaacatgtggtgtttggttttctgttcttgtgatagtttgctgagaatgatggtttccagcttcatccatgtccctgcaaaggacatgaactcttccttttttatggctgcgtagtattccgtggtgtgtatgtgccacattttctttatccagtctatcattgatggacacttcggttggttccaagtcattgctattgtgaatagcaataaatatacatgtgcatgtgtttttataatagaatgcttcataatcctttgggtgtatacccagtaatgggattgctgagtcaaatggtatttcttgtcctagatccttgaagaatcgccacactgtcttccacaatggttgaactaatttacactcaccaacagtgtaaaagtattcttatttctccacatcctctgcagcatctgttgtttcccgactttttaatgatcgccattctaactggcatgagatggtatctcattgtggttttgatttgcatttctgtaaggaccagtgataatgatcatttttcatatgtttgttggctgcataaatgtcttcttttgagaagtgtctgttcatatcttttgcccactttttgatggggttgtatttttcttgtaaatttgtttaagttctttgtagattctggatattagccctttgtcagatggatagagtgtaaaaattttctcctattctgtaggttgcctgttcactctgatggatggtagtttcttttgctgtgcagaagctctttaattagatcgcattggtcaatgttgccttttgttgccattgcttttggtgttttagacatgaagtctttgcccatgcctgtgtcctgaatggtattgcctaggttttcttgtaagatttttgtggttttaggtcttacgtttaagtctttaatccatcttcagttaatttttgtataaggtgtaagaaaggggtccagtttcagttttctgcatatggctagccagttttcccaacaccatttattaaatagggaatcctttccccattgcttgttgtgtcaggtttgtcaaagatcagatggttgtagatgtgtggtgttatttctgaggcctctgttctatcctattggtctatatatcggtttggtaccagtaccagaggaaagaacaggcagtaatgattgctgttctgcagcctctcctggtgatacccaggcaggcaaacagggtgttttggttactgtagccttgcagtatagtttgaagtcaggtagcgtgatgcctccagctttgttctttttgcttaggattgtcttggctatgagggatcttttttggttccatatgaaatttaaagtagttttttctaattctgtgaagaaagtcaatggtagcttgatggggatagcactgaatctatatattactttgggcagtatggccatttttgtgatattgattcttcctatccattagcatggaatgttttttcatttgtttgtcctctcttatttccttgagcagtagtttgtagttctccttgaagaggtccttcacaacccttgtgagttggattcctaggtattttattctctttataacaagtgtgaatgggagttcactcatgatttggctctcttgtttgtctgtttttgttgtataggaatgcttgtgatttttgcatattgattttttatcctgacacttttctgaagttgcttatcagcttaaggagatttggggctgagacaatggggttttataaataattgaatcatgtcatctgcaaacagagacaatttgacttcctctcctcctaattgaataccgcttatttctttctcttgcccgattgccctgaccagaacttccactaccatgatgaataggagtggtgagggagggcatccttgtcttgtgctaattttcagaaggaatgcttccagtttttgcctattcagtatgatattgcttattggtttgtcataaatagctcttattattttgagatacattccattgatacctagttcattgagagtttttagcatgaaggggtgttgaattttgtcaaaggacttttgtgcatctattgagataatcatgcggtttttgtcattggttctgtttatgtgatggattacgtttattgatttgtgtatgttgaaccagccttgcatcgcagggatgaagcctacttgatcgtggtgggtaagctttttgatgtgctgctggattctgtttgccaatattttattgaggattttcatatcgatgttcaccagggatattggcctgaaattttctttttttgttgtgtctcttccaggttttggtatcaggatgatgtcggtgtcataaaatgatttagggaagatttcctttttttctattgagtggagtagtttcagaacgaatggtactagctcctctttgtacctgtcgtagaattcagctgtgaatctgtctggtcctggacttttttttggttggtaggctattaattactgcctccatttcagagcttgttattggtcggttcagggattcgacttcttcctggtttagacttgggagggtgtgtgtgtccacgaatttatccatttcttctagattttttagtttatttgtgtagaggtgtttatagtatcctctgatggtagtttgtatttctgtgggatcagtggtgatatcccctgtatcattttttaatgtgtctatttgattcttttcttattcttccttattagcctggctagtggtcaatatattttgttgatcttttgaaaaaaatagctcctgaattcattgattttttgaagggtttttcgtgtctctatctccttcagttctgttctgatcttagttatttcttgccttctgctagcttttgaatttgtttgctcttgcttctctagttcttttaattgtgatgttagggtgtcaattttagatctttcctgctttctcttatgggcatttagtcctataaatttccttttacgcactgctttaaatgtgtcccagagattctggtatgttttgtctttgttctcattggtttcataaaacatctttatttctgccttcattttgttatgtacccagtagtcattcaggagcaggttgttcagtttccatgtagttgtgcggtttcgagtgagtttcctaatcctgagttctaatttgattgcactgtggtctgagagactgtttgttatgatttctgttcttttgcctttgctgaggagtgttttacttcccattacgtggtcaatcttagaataagtgcagtgaggtgctgagaagaatgtatattctgttgatttggggtggagagttctgtagatgtctcttaggtccacttggtccagagctgagttcaagtcctgaatatccttgttaattttctgtctcgttgatctgtctaatattgacagtagggtgttaaagtctcccactattattgtgtaggagtctaagtctctttgtaggtctctaagaacttgctttatgaatctcggtgctcttatattgggtacatatatatttaggatggttagctcttttgcatttatccgtttaccattatgtaatgcccttctttgtctcttttaatctttgttggtttaaagtctgttttatcagagattaggactgcaactcctgccttttttttttttttttttgctttccattttcttggtaaatattcctccatcactttattttgagcctgatgtgtctttacaggtgagatgggtctcctgaatacagcacactgatgggtcttgactatccaatttgtcagtctgtgtattttaattgaggcatttagcccatttacgtttaaggttaatatgtgtgaatttgatgctgtcattatgatgctagctggttgttttgccctttagttgatgcagtttcttagtagtgttgatggtctttacaatttggtatgtttttgcagtggctggtactggttgttcctttccatgtttagtgcttccttcaggagctcttgttaggcaggcctggtggtgacagaatctctcagcatttgcttgtctgtaaagtattttatttctccttcacttatgaagcttagtttggctggatatgaaattctgggttgaaaattctttttcttttggcggatcacgaggtcaggagttcgattccagcctgaccaacgtggtgaaaccccgtctctaataaacatacaaaagttagctgggcgtggtggtgcgcgcctgtaatcgcaactactcaggaggctgaggcaggagaattgcttgaacctgggaggcggaggtggcagtgagctgagattgcaccactgcattccagcctgggtgacagagagagactccatctcaaaaaagaatactggccctcattctattctggcttatagggtttctgccgagagagatccgctgttagtctgatgggcttccctttgtgagtaacctgagctttctctctgggtgcccttaacattttttccttcatttcaacttcggtgaatctgacagttatgtgtcttggggttgctcttctcaaggaatatcattgtggtattctctgtatttcctgaatttgaatgttggcctgtcttgttaggttggggatgttctcttggataatatcctgaagagtgttttccaacttggctccattccccctgtcactttcaggtacaccaatcaaacgcagatttggtattttcacatagtcccttatttcttggaggctttgttcatttctttttattcttttttctctaatcttcttgctttatttcatcaagttgatcttcaatctctgatatcctttcttccacttgatcaattaggctattgatacttgtgtatgcctcacgaagttctcgtgctgtgtttttcagctccatcaggtcatttattttcttctctacactgattattctagttagcaattcgtctgaccttttttcaaggttcttagcttccttgcattggattagaacatgctcctttagctcggattagtttgttgttacccaccttctgaagcctacttctgtcagttcatcaaactcattctctgtccagttttattcccctgctggtgaggagttgtgattatttggagaagaggcgttgtgttttttggaattttcagcctttttgtgctggtttctccccatctttgtggatttatctacctttggtctttgatgtttgtgaccttcagatggggtctttgagtggacatgctattcctttctgttgttagttttccttctaacagtcaggcccctttgcttccggtctgctgcagtttgctggaggtccactccagaccctgtttgcctggatgtcaccaggagaggctgcagagcagcaatcattactgcctgttctttcctctggaagctttgtcccagagggacacctgccagatgccagccagagctcttctgtatggggtgtctgtccgcccctactgggaggtgtcttccagtcaggatacatgggggtcagggacccacttgaggaggtagtctgacccttagcagagtttgaaaactgtgctgggaggtctgctactctcttcagagccattgggcagggatggttaagtctgctgaagctgcacccgtagccaccccttcccccaggtgctctgtcccagggagattggggttttatctgtaagtccctgactggggctgctgcctttttttcagagatgccctgcccagagtggagaaatctggcagtctggcctcaatggccttgctgagctgcagtggggtccacccagttcaaacttttgggctgctttgtttacactgtgagggcaaaacgcctactcaagcctcagcaatggcagatgcccctccttccaccaagcttgagcatcccaggtggatctcagacagctgctgtgctggcagtgagaatttcaagccagtggatcttagtttgctgggctctgtggcggtgagatctgcagagccagaccacttggctccctggctttagccctctttccgggggagtatagggttctgtcttgctggcgttccaggtgcccctgtggtatggaaaaaacaatacaacaacaaaaaaaactcttgcagctagtttggtgtctgcctaaatggccgcccagttttttgcttgaaacccagggccccggtggggtaggcaccggagggaatctcttggtctgtggattgcgaagactgggaaaagcgtagtatctgggctggaatgcactgttcctcacggcacagttcctcacagcttgccttggataggggagaaaattccccaacctcttgcccttcccaagtgaggtgatgccccaccctgcttcagctcgccgtctttgggctgcatccactgttcaaccagtcccagtgagacgaactgggtacctcagttggaaatgcagaaatcacccaccttctgcgtcaatcttgctgagagctgcagactggagctctttctattcaaccatcttgcctgggaacacacacatttttctatttgaatgttgccccgggtggtactgttactcttcttttccagtctttgccaccccacatgtaggcagttgccggtatgaaataatcaaaaggataagaatccagcttaaaagagtttattcaaacacaaagctgtggatgcccatccaggaaacacagactccaaggaaatagggtcagtgcttcaaagttgaaaagttaagatcatatttgtataggcagaaaacaaagatatttagcagaataacattttccacacaaagttggcttctgagttacagcaatttgattagttacagcttgtttgttttctttttccaatttaaaagaatatatttaacagtccatcttagaaagtgtgtctttgtgtaagagaagaaaaagggaagttaatctataatgaagatcaacagtaaagagggaaggagtcttctttgacatcctttagttatttgcagcatttagcaaagcagtgtaagttaggggggaataaaaggctaatctgtagtcagggaaatcaaggctatgtctgcctaggttacagctgcctgttagtgactgaggtcccaaaatcacattcctttaaggctcagaataaaagttccaaaatttggttttgaattacttattttcacacaatgaaaatatgaagaatgactgagcattgacagggagatgagttcattgggtggtattatttgcttactgcttgttttttgcctacactaataaaagttgtcaatacttgtgaggatagggaacagaaaaaaatgaaaaactatactttagtccagtagttctcagtgaggtcactggatcagaaactccatcatataagaacttgttagaagtgtggattatctggccccacccaagacttagtgaatcagaaaccttggggacgagaccagcagcctatgttttaagaaaccttcaaagtaattgtgataacctatttcaccccagggattggcagtctgcagcctatggacctaatctggtctataacctgtttttttgtaagtaaaattttattgaaacaaaaccatacccatttgttcattttagtttgtggatgcttttgtgctacatcagcagagttgagtagctgcaatagagaacatatagccaaaagtatttaccatcaggttctttacagaaaaagtttgctgactcctgctttaggccttaggcactagaggcgcaaactctgaatttatgaggatatatttgctaattaaattgagaaccatgaggaaaaaaggtgaaacttttcctgtttttaaaaattttaacctgttatttttcccttttagtcaaggatgctatctaaatgggccttttaattcaaatctactgactatcccgaagcaaaggtcatcttctgtatcactgactcaccatgtaggtctcagaagagctggtaagaaatcattctttatgactcaaatatgggggttctcaaagtatatggtagtgtaaacacttttcatcacatatttatagctaattttgaatacaatttcatgtattataagttaacatgacttagcagtttgggttggctactaattgaccgtttgctaattctttcagtaaaaacagttttagaacatctactctgtaccaggtattttgctaagcagtagggattcagagataaaatatataactatttaactaacctgaatggttgcagacccaggacaagggaaaatcttcaagaaagagtatttttttttttcatagaatgataattgtggagaaaaaaattttaggattagaatagaaaaaaccatgacttcatcctggaaaaacattatgataggaattttttttaattaaaagattatagaatgattaaaaactcttggatgcaagatattttaataaatacaacataggaatagcaaagcaatactgatattgtgcttttaaagtacattatggctgatatcacataggtacaattttgtgattgggatatacaattacaaaattcttttatacacaataacctataaagcatgtgaagagatcagaaaatattattgataatcaagaaaagtaggcactagaaaaagatctatatatgatattgatgctgtattttacaatctttaaaataacaatgatgtttaaaaggaaatagaaggaataatggccaaaatgaatggatacttcgaatagagaactagaacacatagaaaagaaatggacagtctagaactgagaaatgcacttgattaaattaaaagcttattcaagggtttaagaatggattggatacaacagaatacaaaagtagtgaacttgaagacagagaaatagaaaatacccaaactgaagcacagagaaggaaaaatacataaataacagaacaaagtttaaaagacatatgggacacagaagttctaaaatatgtgtgactgaagttccagaaggaaaggagagaaacaaaaggacagaataacttcgcaaaactaataaaagaaagcaaacaacaaattcataaagtgcagtgaaccccaagcaggataaatacaagaaaatcacagctagatgtatgaatcaagcctccaaattataaagaaaaagtttcaaaagcaaccaagcaaggttgtttttatttttcaaggaacaacaataatgatattgacagtgacttgttaacagcaactgtgaactccaaagacaatggcatatttgaaaaagtgtggaaagaataaaacttgacagcatagaattctttatccaatgaagaaatattcttgaaaaattaaataggaataaaaattttttttagtatcctcacttccctgcaacagtaactgtggtgatgggtatgttaattaatttgattgtcataatcatttcacagtaaaaatgtaaatcaagtcattatgttgtacaccttgaatacatgcagtttttgtcaattgtacctcagtaaatctggaaaaaatcttttagtaaatcagatgagaagtagaaaaacgtacatttttttcaaacaaacaaaagctgaaataatttgtagctggcagacctgtgctactaagattcagtaaaggaagtttcttaggcagggggaaaattatccagattgaagcatggaactacaagaacaaaccaaaagcactggtaaggctaaatagatgggtgaggattaaaaagtgttgatgggtcaaaaagttggcaaaggatatgaatagacacttctcaaaagaagacatttatgcagccaacagacataggaaaaaatgctcattatccctggtcatcagagaaatgcaaatcaaaaccacaatgagataatatctcacgccagttagaatggcgatcactaaaaagtcaggaaacaacagatgctggagaggaggtggagaaataggaaggcttttacacagttggtgggactgtaaattagttcaaccagtgtggaagacagtgtggcgattcctcaaggatctagaacaagaaataccatttgacccagcaatcccattactgggtatatacccaaaggattgtaaatcatgtggctgggcgtggtggtgcacgcctgtaatcccagcactttgggaggccaaggcaggcggatcatgaggtcaggagatcgagaccatggtgaaaccccgtctctactaaaaatacaaaaaaaaaaaaaatcagctgggcgtggtggcaggcacctgtagttgcagctactcgggaggctgaggcaggagaatggcatgaacctggaaggcagagcttgctgtgagccgagatcgtgccactgcactccagcctgggtgacagagcaagactctgtctcaaaaaaaaaaaaatcatgctactataaagacacatgcacacgtatgtttattgtggcagtgttcacaatagcaaagacttggaaccaacccaaatgtccatcaataatagactgaataaagaaaatgtgaggccgggcgcggtggctcatgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctatttgggaggctgaggcaggagaatggcatgaacccgggaggcggagcttgcagtgagccgagatcccaccactgcactccagcctgggcgacagagtgagactccgtctcaaaaaaaaaaaaaaaaaaaaaagaaaaaaaagaaaatgtggcacatatacaccatggaatactatgcagccataaaaaaggatgagttcatgtcctttgcagggacgtggatgaagctggaaaccatcattagcaaaccatcacaagaacagaaaactaaacaccgcatgttctcactcataagtgggagttgaaaaatgagaacacatggacacagggaggggaacatcacacactgggaccaatctgaggctggggggctgggggagggatagcgttaagagaaatacctaatgtatatgacgagttgatgcatgcagcaaaccaccatggcacgtgtatacctatgtagcaaacctgcacattgtgcacatgtaccctagaacttaaagtataataataataaaaaaattgatgggtaaacacaataataactttcttttagcatttatgaaatacataaaagtcaaatatataacaatagcatagagggtagtcaaggggtaaatggaattaaatttgtcgtaaggtactagcaatgcttgaaaaacagtaaaaagttctaatttaagagaagctaatattcaaagatgaacattgtagtattcagggggccaattaaaagaccagtagaaaaagatataactaaaaagcttataaggaggtaaaatggcatgattaaaaaaagcttgaataattcaaaagaatctgagaaaagaaaagcaaaaacagaagaaacacacaaaaaataaatagcagcatggtggattaaacacactttattacattaaatatacacctttggggtagaggaagggatctgactagagttgtcagtatattatctgaaatgtcaagttttcaacaaaaattggactttacgctccaattaaaagacaaagattaggctgggcactgtgactcacacttgtaatcccagcactttgggaggctcaggtgggtggatcacctgaggtcaggagtttgagaccagcctggccaacatggtgaaaccccatctctacaaaattcaaaaatacaaaatacaaaaattaaccagacgtggtggtgggcgcctgtaatcccagctactcgggaggttgaggcacgagaatcgcttgaacccgggagacagagattgcggtgagccgagattgtgccactgcacttgagcctggacgacaaagcgagccttcgtctcaaaaaaaaaaaaaaaaaagtaatcttctgactgctcattggttgatgtccaaattatactgatccccccagggatgacttctaggaaaccatgcttaaaaatataatcaaaaacttaagagaaaaagctaacagaaaactgagtaactacacattgcaggagaaacagaaactacacaattagttcaggtaagtcactaaacaaattatcagaaagaagaaaacacaaagccagcaacataataaacctttggtgttggagggatctgatatcaaaactttacagtattttatgtaaaatgtacgattttcaagaaaaatatgtgaaacatgcaaagatacaagaaatttttgacatgtacccaaggaaaacgtaacccatagaaattatccctgaagtggattggattttagacttagtataaaacaaaactgtaacattgttttaataattataaagtaaggctacttttactcaatattggattagaggttctagccagggcaattaggtgagaaggaataaaaggaaaaagtaaaattgtatttgcagatggcatgagcttgtatatgtaaaatcctaagaaattcactgaaacctattatcaccaataagtttatcaatgtggcaggatatacaaaatcaattttatttctatatgctaacattaaggaatccaaaactcaagttacagaacgatttctgtttacagttagcattgaaaaaatctttgaaataaatttagcaaaatagtacaagacttttacaatggaaactataaaatattgttgaaattaaagaagacctaaatatattggaagacattccacgtttaaggatcagaagacttaatattattaagatggcaatattctttgaattgcactagattcgatacagtccttatcaaaatttcagctttgccaaaattgacagtctgatgctaaaattcgtatagaaacgcaagagtcccagaatagccaaaacagttctttaataaaaaagaagaaaaagtacgaggactcccactttcaaattttaaaacttactaccaggctacagtaatttagtatggtactggcatagagatatttctattcaatgaaattcaatttggcagtttctcaaattttaaacatgaagttaccatatgacccagaaattctacttcttgatatatatccaagagaagtgaaaccgtaggtccacacaaaaacttgtgcataaatgtgtatagcagcattattcataatagctaaaattagaaacaacctaaatggctatcaataaatggttaaacaaaacgtggcttaaccatacagtagaatattttttgtcacaaaagtgaaatggagtagtattcatatgccatgaatgaaccttgaaaacattatgctaagttaaataaggcagtcacaaaagactacaaattgtacaaatctactcatataaaatgtctaaaatggacagatctatagatagagaaagtatattagtggttgctatggttttaatgcttgtgtacttccaaaattcacatgttgaaacctaatccccaatgagacagtattaagagatggggccttttggagatgactaagcatgaggttggagcctttgtgaatgagattagtgctcttataaaagaggcctgaggaagctagctatcctgtcagccatgtgaggatacagtgaaaaaagtaccatctgtgaggcagaaactgagccctaatcagacatcaagactgctggcaccttggtcttggacttcccagcctccaaaaactgtgagcagccaagttctattgtttacaaattgcccagactaaagtattttttttttttaggtggtatagatggaattttaatacagtgaaagaaaatagggagtactgagttaatggttttgggtcatctttataattatctggtagaagactgaatttccatcttacatattatatacacagaaatctacagattggctacaatttaggtgttcaaaatgggaattaaaagtattataaaagcatataagattcagaaagtttaaatagataaatattttctaataataaaaccattaaaagttgataacatttttttttcttttatttattattatactttaagttttagggtacatgtgcccaatgtacaggttagttacatatgtatacatgtgccatgctggtgcgctgcacccactaactcgtcatctagcattaggcatatctcccaatgctatccctcccccctccccccaccccacaacagtccccagagtgtgatgttccccttcctgtgtccatgtgttctcattgttcaattcccacctacaagtgagaatatgcagtgtttggttttttgttcttgcgatagtttactgagaatgatgatttccaatttcatccatgtccctacaaaggacatgaactcatccttttttatggctgcatagtattccatagtgtatatgtgccacattttcttcatccagtctatcattgttggacatttgggtcggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctcggatggccagtgatgatgagcattttttcatgtgttttttggctgcataaatgtcttcttttgagaagtgtctgttcatgtcctttgcccacttgttgatggggttgtttgtttttttcttgtaaatttgtttgagttcatcatagattctggatattagccctttgtcagatgagtaggttgtgaaaattttctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttgtggttttaggtctaacgtttaagtctttaatccatcttgaattgatttttgtataaggtgtaaggaagggatccagtttcagctttgtacatatggctagcgagttttcccagcaccatattaaatagggaatcctttccccattgcttgtttttctcaggtttgtcaaagatcagatagttgtagatatgcggcgtgatttctgagggctctgttttggtaccagtaccatgctgttttggttactgtagccttgtagtatagtttgaagtcaggtagtgtgatgcctccagctttgttcttttggcttaggattggcttggcgatgtgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccctcacgtcccttgtaagttggattcctaggtattttattctctttgaagcaattgtgaatgggagttcactcatgatttggctctgtgtttgtctgttattggtgtataagaatgcttgtgatttttgtacattgattttgtatcctgagactttgctgaagttgcttatcagcttaaggagattttgggcttttttttatagcaagttgaatgaactaagacagtggtcccttgtgactatgggtaggagcgacaggaatagagaatgactgctaatgggtctatggtttctttttgagtttatggaaatattccagaattagatagtggtgatagttgcacaactctgtggatttctaaaattcagtgaattgtacaatttaaaatagtaaattgtatggtatatgaatgatatcttaaaaggctgtttaaaaaacacgtaagcatgttctgtcaccacagtggaattagatttgaaaacatctctcaatagatctgcagaaaatcctcaaattataaataacctatgggtcaaagaagaaaaagcaatgaaaatcagaaaatattttgagctgaataataatgaaaataggacttattaaaatgtcggaagaagctaaagcagtgctttcttgggaaatttatagcaaaaaaagagaaaaattaaaaatctgttaagcttacattttaagaagctataagtttcacagcaaagtaaaccaaaagaaagaagaaaacatgacactgatacaaaaagattacactgatacaaaaatgataaaaaatctgaagagtcatatatcttctaacgaaattaaacctgtagttaaaaaccttcttacaaataaaattgtaggtccagatgactttactggtaaattcttccctatatttaacgaaaatgttgttatgaaaggttatatccaatgccttagttttctatagctgcttgctgtaaactgcatattcatatctcctcacttacaccccaattcatgtgttgaaacctaatcctcagtgtgatggtatttggagctggggcctttggaatgtgattaggtcatgtgagtggactcttcatgaatgggatgagtgccttataaaagagacctcaaagagctctctaatcccttccgccatgtgaggacacgagaagatggccgtcagtgaaccaggaagtgggccatcatcagacaccacatctgccagtgccttgatcttgcacttcccagcctccagaactgtgagaataaatttctcttatttataaaatacctagtctatggtattttgttatagcaatccaaagggactaacacactactgtatcaaattaccatatgcttagtgacttaaataacacaaatttatacttataattctggaggtcagaagtttaaaattgatctcattgggcccaaagcaaggtgtcagcagggctatgtgtcttctggaggctttagggggtaatccattttctttgcattttccagtttccagaggccttcctagagcttgcctgcctggattcctggcccatggccccattactccatcttcattgccagcaatgtcagtctgaatcctgacgctgccatctctctggctcttttatgtctgcctctctcttttacttaggcataggacttagccgtgtgtgactcctgtaatgacaagaacccttgtcattacattgagcacaactacataatccaggataatctccccatctcaaggttagctgatcagcaaccttaaggccatttgcaatttaaatatccctttgccatgcaatctaacatataggttctgtggtttaggatatggacatctttgggggtgattattctgcttaccacagccaatcttacacaactctttcactgaaaagggaaagaggaaacaccagttttttatgaggccagcataaccctaatattgaaacctgacaaggatattacaagtaaattagaggccaacatctcttgtgaatatagatacaaaaatcctaaacaaaaagttacacatataattgagtaatatattaaaatgataataccataatgttcatgttgggaagtattattacaggaatataaagtctgtttaacctttgaaaattcactgcattaatagaataaaagagaatactcatatggtcatcttaattggtacagagaaagcttttcatgtatgttcatttgataaatttgataattatgataaaaaattataagcaaattgggaatagaggggacatttttaatctgataaagtatctatcaaaaatgtttttcaaacataatacataatgaaatactgaacatttttctcctgactttggaaacaagataaagatgttcactgtaaatacttgtctccaacattatcctgtaatttctagacaatgaatgaagacaagataaagaaaaggaataaatattggaaaggaagatataaacccttttatttatttgcagattaccattttgtatacatggaaaatctagaaggctctaaaaatatagtaatagaattaataagtaaattttgcaatattttaattgtacagaaaaattaattatattactctatactatcagaaaatggttaaaatgaaatttaaaacaccatttaccacagcatcaaaagccaccaattacgtagagataaatttaataaaaaatatgcaatgctgctacactccataacttcagggaaaaatttccgtaacaagacataaaaatacttaccatatgggattagatgaataaatttgactacatgaacattaataacctctttattgaaaaaagtcatataaaggccaggcatggtggctcacgcctgtaatctcagcacttagggaggctgaggctggtggatcatttgaggtcaggagttcgaggccagcctcgtcaacatggtaagaccccatctctactaaaaacacaaaaaaattagctgggcgtggtggcgggcacctgtagtcccagctacttgggaaagctgaggcaggagaatggcatgaacccgggaggtggagcttgcagtgagctgagatctgagatcacgccactgtactccagcctgggcaactgagtgagactccatctcaaaaaaagaaaaaaaaaaaaagctaggtgtagtggcgggtgcctgtaatcccagctatttgggaggctgaggcaggagaattgcttgaacccaacagatggaggctgcagtgagcccagagtgcaccactgtactccggcctgggcgatagagtgagactccatcaaaaaaaaaagtcatataaaaagaattgaaaatagtaacaacatctgagaaggaactagaattcagctgtataaagaactttgtcagtggaagaattatggacaactattcattttctattgctgcatatcagattacaacaaatgtagcagcttttgtgcaagagtccacacacagctgagtcctctgcttgaggtgtcataagtctcaaaacaagatgttggctctaccttgttctcatctggagaatcagctgggaatgaatcggctgccaagctcattcaggttgtcctcaggttgttcttcatttccgttggttgtggattcttgatggctctgggttcttgatggctattggctgggggccacccacagttcgtagaggctgcccatagttttttgtcacatggtcttcctcagtatggctgcttacttcatggagctagcaagaagaatctctagagtgagtctctagcaagatggaattcataatgaaacataatcataggggtgacatcctgtcatctttcttttgataagaagctagtcacaggtgttttctacacaaagacatgaacaccagggggcaagggttaatgctaccttagagtgtgtccatcaccacaagccaatagaaaaattagcaaaagacttgaatgaggatttcagaaaaaaaactatacaaatagcatataaacatgaaatgtgcttaaccttattagtaatgaggaaattaaaaagtaaaggtacggtgctcttttatttatcatcagattggcaaaagataaagaacattatatttatacacacacacacacacacacacacacacacacgcagagaaagagagagaaagtttgttttaagggattggctcacacaactgtgtgggcttgcaaggcaagcaagtaggaagttttcaggacaggctggcaggctgaaaattccagcagggttaatgttgcagtcttgaacctgagacaaaattttttcctctttatgagacctcagtcttttctcataaggccctaagctaattggatgaggcccacccatgttatggaaattaatctgctttactcaaagtttattgatttaaatgttaatcacatctgaaaaatatcttcacaacaacatctatactagtgtttgaataaacaactgagcaccataaccaagttgacaccatcgcacacatctgtaagtgtttaccactatgcctgaaaatattgtagctccttaatgactgttacttgttttcctttctgaatgagactttacttgggtctttattttcaaataaggttataaatctgcctgcatctttccagatatacccacactgctttagtttgaggcactcagcaaaggtttctggaataaatagacagaattatagactcatcttatgtgttcctgaagcactctgttttgttcccttattaagcacttagcacttgtttgtattcttcactacactctagcttcattgaatttcagggatggtatctttttcttcattgtgaaaaccagtatattttccagcatatagtaagctctaaatatttgttgaatgaatgaatgagctggaaatactttcatgtaatttttaaagcgatctgacattgcattaacatatgatgttattctcaacttgcttaaatgctattaagaattttagttcttacttttacactgttggtgggactataaactagttcaaccattgtggaagatagtgtggcaattcctcaaggatctagaactagaaataccttttgacccagccatcccattactgggtatatacccaaaggattataagtcatgctgctgtaaagacacatgcacacctgtgtttattgcggcactattcacagtagcaaagacttggaaccaacccaaatgtccatcagtgatagactggattaagaaaatgtggcacatacacaccatggaatactgtgcagccataaaaaaggatgagttcatgtcctttgcagggacatggatgaagctggaaaccatcattctgagcaagctatcgcaaggacagaaaaccaaacaccatatgtcctcactcataggtgggaatgaacaatgagaacacttggacacagggtggggaacatcacacactggggcctatagtggggtggggggacgggggatggatagcattaggagatatacctaatgtaaatgatgagttaatgggtgcagcacaccaacatggcacatgtatacatatgtaacaaacctgcacattgtgcacatgtaccttagaacttaaagtataattaaaaaagaaaaaaaaagaattttagttctttggccagatgcagtggcttaagcttgtaatcccagcattttgggaggctgaggcaggaggatgacttgagcccaggtgtttgagaccagcctgggcaacatcttgaaaccctgtctctacagaaaaataggtaaattagctgggcacggtggcctgtgcctgtagtctccaaggccagaggatcaattgaacccaggaggttgagtctgcagtgagccatgattgtgccactggaatccagcctgggcaatgaaatgagaccccatctcacagacaaaaaaagagaatttaaataaaatttaattttattgaattgaaaataattcaataaaatttggtagagatgctttgctcttgtggataatcaatctgatagggacacataggtgaaagttaaagaccaataggaattaggaaaatttctgccatacagtatgtatgttttagtcatactgttcacatttacctattataaatgtagatatttacccaacaaggggtgtttacccaacagccattgatcatgacaaatatggcaaatattgcataagtttctagaatattgtgaggccccatgcaggaatttataatttatttgtaaataatctgctttttttaaataaggaaaaaatccataaaaacacaaatatatttaataaacatacacacataaatacattcttatttatctatctcctttcttttaatttttaaaggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacaggtaagtttcccaactgtttattatttctgtttcaaaatgttgattacagttaagtcctcaacattttggataggttcttggaaactccagctttaagctaaatgaccatagtttttttcggtgttataatgaaatgacattattttaagatgtgctataagttgtttcacttaaaatgtcagttttcaaaaacttattgatgatattgaggactttactgtattttaataaagtattaccagttttctagttctatgttataactagatgatggattcagcctatattcttttccttatttatctagtagtttttattctaaataaatatcttctcattttagtggttattaattttttaaattaaatggtctccatctgagctaaaatataatggtattctacccatcctaagatcttagtaaatattaaagtattttagtatacactactttagtacctattcatagtacccagtaaatggtgtttgatcttatttctgctttactaatagtaagggtttacctcagatccaatgttgacttttcaaaaatattttgtttccttcaaggacacacagatactttctaggttaaagcctttgaactttatggagagattggaattttaggatgcgttgcagttgggatcttggttaaaaattaaacagattttctaattgtgttcaggtaaaaaacttgtacctcatttaccgtatatatttatctattttattctataagctgtggacatcaaatgctgaaatatgtttcaacatctgaatcagatggtacagattgctgcagtggaaaatcaggtgagattacaaaagtcatatgtatttgagtttaagagaaatttcttacaatgatttttagaatgggaaaatgaatgagtttaacttcagtttatccatctttaaaatgaagattattattttttacccacttcacagaggacttatttagaacaaattataagtaatagatggtgaaagtaattcaaagaataaaaatgtcccatacaaatgaatgtagtcttcttaggttatgtctattgtttataaatagtggaattatttatattaaacattgaaatttgtagtgcacaatctaaatccaaacggttttgcataaattttttatggcataaagaggggttgttttaaagtgtggttaattatatcattctgaaatattttgtatcctcatacaagacatattgtgttgatgaaattatagttgttttataaccttaaaatttgatgactcaaactaccagtagtagttaactaagtaactcagaccaacatttcccctgagggcagctagaaaaggtggatgaattatttttttaaaaaaaatctacttgaagccattgaagaactaaaaaaatcttatgaatcaccagtacaagatctgttggaagacagaactccaagaaagtgagcctggagtttggggctatcaaaagagtgtatgccaattccacagagaccaatgactgataggatgagcaattttattagcagcttcatggggctaggaagacagaggctagagttgaaggcttgccatggtttggataacttgataaactctaaagtgttgtatcctaagaaaaaagttaaaccaaaaatagataagccttttcagggattataggttcttctcaatccctttacataccataaaacttacccttttaaagtgtgcaatttaatagttttttgttttttacattttaaaggattgttaacaaataaaataaaataaaaagactaattcttcacaaactcttccaaaaaatagaagaggagggaacacttcccaactcattcttttttttttttttgtatatcattacaatggaattcagttcagcaattaaaggaataaacttctgatacatgctgcaacatagatgaacttcaaaacattattctaagtgaaagaagccaggcccaaaagatcatatattatatgattacatttatatgaaattcttgaaagacaaatttatagagacaataatcagaacagttgttgcataaagtgagaatagggattaactataaataggcatgaaggaacattttgggtgggggtgttgagaatgttctaaaattggattgtaatgattgttgataactgcaaatatactaaaattgttaaattgtacacttgtgggctggatgtttgtgttcctccaaaaattcatgtgtcgaaatcctataccctgatatgacggtattgggaggtaaggcctttgggaggtaattaggtcatgaaggtggatccttcatgaatgggattagttcccttataaaagaaccccagaaaactctctttcccaccctctttcccaccgtgtgaggatacaatgtgaaatcggtagtctgcaatactggaacttggccaggctggcaccctgatatcagacgtccagcttccctaactgtgagaaataaattcctatttttttataagccactcagtctgtagtatccaattatagcagcctgaactaaggcattttacaatgggtagattttaatggtatgtaatttatactcaataaagtttttaaaaagaacaataatttattaagtgtcatatttctttgggtggactagcctcaactgggagattctcacctgaggactttgatgagattgcagtcagtgcagtcagatattggttggggaagcagttatctgaaggattgattgggcagaatttccaagatgggttactcatgtgccttttggctattgaccagtccatctaaatatgacccctccatgggcttcttcagtttgttggcagcattccaagagagtaggaagtggaaactaccagttcagttaatggctgaactcagaacagagtgtcacttctgccatattctgttatcagagcagtcatgaggcctgttgagattccagagggttggtaaataaatgctctgtcttgatagaggagtgacaagaatacatttcagaaaagtgtttgggacaagagatagtgttgtagacatctttagaaagaaatgcttcatttacctcacctgtttttattattatctgtaagataatagttattaggagttcatatcattaaaaagtaaattatgtaatatacctcaagtgcaaacaacttttagattaacttctattttagaatatcattgtagttattgccttaccttaccaagaatactcgaatagtctaaatttaatttcttagactaatttttttcatttggaaaaaataatattttctaaacagtaatacttccagatcatcatctaatcaattaatgattggtatattcattgtattaagttgagattatactgacatttattaatcacctattatgtataacatcttgtaagatgggtattattatccaaattttacaggggagaaagcttgccattattaagtacgaaaatcaggatttgaacctagttttctgaaactcaactccaatgattactcttaagaatttttttttttttttttgagacagagtcttactctgtcatccaggctagagagtacagtggcacaatcatggctcactgcagcttccaactcctgggctcaagcaatcttccctcctcagtcttctgagtagttgggactacagcaccatgcccggctaattaaaaaaatttttttttgtagagatgagaactcgctctgttgcccaggccagtcccaaacttttggcttcaagtgatcctcccgccttggcctcccaaagcactaggattataggtatgagctgttatgcctggccaagatctctttttacaaaaaaacaaacaaaactctacatattgagcttatagcatgtaattatcatataatcagcacccagatccagaaacaaaataagaggctggccaaaatggccaactagaagcagctaatgtgcactgctgtcatggagagaaatagaaggggtgagtacatacagcaccttcaactgaaacatacatgtacacatgttgggattcatcaagaaaacaacccacagagaatgtagaaaagcaaggcaggatgactgcccacctgggagtgacacggagccaggggagcctccctcgcccagggaagcatgagtaagtgggcaaccctggggacccatgcttctcccataggtctttgcaacccttgagtcaggagaccctcctcgtaaacccactgcaccagggcttgcagtctgatatgcagagctctgtggcatcttggcagagtagctgctcaggcacatgtggagccccaggagctatagatacttgggtttctaggcaaaagcagctgcaacttggcaaagtaggaggttagacccccatacagacccctaagaagtagctgaattcaggggtctgagcagcaatggtcttcaggtcccatgtccacagcaccttgcaggataagaccactagcttggaactccagccagccactggtagcagtgttgatggagctcccagagggaggggtaggctaccatctttgctgttttgcagccttagccattgttgccttcagtgtaaccaccctacaaaaatgcagccagcttgcttttttatgtgggtccctgacctctcttctcctcactgggcaggacctcccaaccaaggtaaccagccactcttgccactgtttttcagctggcagtggttccgagcctccctgagatagtgctcccgggggagggacaggccgccatctttgctgtttcacagccttagccattgttgccttctggctctaggaagtccaaggtgactaggtactggagccgtctctcaccgcagcacagtagctctatgggaaagcagctagactgctttttcacatgggtcccagatcttatttcttttcactgggcagaatcctgtgaccaaggtctacaaccacccctgctagtgttttctgtccagcaacagtttcaaactttgctgggatggagttcccagagggaggggcaagctgccatctttgctgttttgcagccttaaccattgttgcctttgggatttggagagtccaaagtgactgggggctgcagcagaccccaaacacagcccaactgttatataaagaagtggccagactgcttttttacacaggtcctcaaccctatttctcctcactgggtgggacctcccaactagggtgtccagccatctctgctggtgttttctgaccagcagcagtttcaaacctccctgggatggagctcccagagggatagggggactgccatctttgctgttttacacccttcactgttgataccttcaggtgctagataaaccaaggtgactagggactggagtgtacccccagcatactgcagcagccctacagaaaagtaaccagattgtttgttacttgggtttccaatctcatatctcttcactgggcaggtcctcctggcctgggtctccagctcccctcacctccaggctatcaagccagtagcagctctggaactccctgggaaagaactcccagtgggaggggtgggttgctatctttgctttctcacagccttaggctttgctgtcttcaggctttggagaatctgtggggaccaggggctagctagtccatacccgagcacagagtatccacctcacagaaaagtggtcggactgttctccacgtaggtcctggtcctcacttctcctctcaacctggtactctagcacaaacacgctgtccctgtcagaccacatcaatcagaggcagcccagcagttaaaggaagagccacatgcagagataagaaagaaccaatgcaagaactccagcaacctaaatggtcagtatcttatgacctccaaacaaccacactagttcttaaccaggctgagctggctgaaatgacagaaatagaattcagaatatggataggaacaaagataatcaagatcaggagaatggcaaaacccagttcaacaaaactaagaatcacaataaaatgatacaggagctgacagatgaaatagccagtatgaaaaggaacctaactgatctgatagagctgaaaaacacactacaagaattttgtaatgcaattccaagtacagcaaaagagaccaagctgaggaaagaatcttgaaacttgaagactgactctctgaaataagaaagtaagacaaaaattattttaaaaagaatgaaaaggaatgagcaaaacctctagaaatatgggattgtgtaaagaggccaaatctacacatcattgacatccctgacaggagaaagcaaacaacctggaaaacatatttcaggatatcatccatgaaaacttccccagccttgctagagaggccaacacccaaactcaggaaatacagagaactcgtgcaagattctactcaagaagatcatccccaagatgcataatcatcagattttccaagtttgaaatcaaggaaagaatgttaaaggcagctagaaagggcaggtcacctacgaagggaacctgatcaggctaacagtggacatctcagcagaaaccctacaagccagaagagcctgggctcctatattcaacattcttaaaaaaaaaaaaaatcttcaagaatttcatatccagccaaactaagcttcctcagtgaaggagaaataagatccttttcagataagcaaatgctgaggaagtttgttactaccatttgttactacgagacccacttaaaagagatcttgaaaagagcactaaatatgaaaggaagaaccattaccaggcaatacaaaaaaacacagttaagtacacagacccagtgatgtaaagctaccacacaagctggcttaataaccaggtaacagcacaatgacaggaacaaatccacacacatctatactaaccttgagtgtaaatgggctaaatgccccatttaaaaggcatagagtggcaaactggattttaaaaaaagtaagacccaatgatacactgtcttcaagagacccatttcacaggcagcaacacccataggctcaaaacaaagggatggaggaaaatctaccaagcaagtggaaatcaggaaaaagcagaggttgcaatcctaatttcagacaaaacagactttaaaccaacaaagatcaaaaaaggcaaagaagggcattacataatggtaaagggttcaattcaataagacctaactattctaaatatgtattcacccaacacaggagtacccagatttataaagcaagttcttagagatctacaaagtgccttagactcccacacaataatagtgagagacttcaacactccactgacagtattaggtcactgaggcagaaaattaacaaagatattcaggacctgaactcaatatgggaccaaatggatctgatagacctctacagaactctccactcaaaaacaacagaatgtacatttttctcattgccacatggtacatattctaaaatccatcagacaaccctcagcaaatgtaaaagaactgaagtcatgccaaacatactcctggaccacagtgcaataaagatagaaatcaagactaaaaaaaatcactcaaaaccatgcaattacatggaaagtaaacaactggctcctgaatgacttttgggcaaatagtgaaattaaggcagaaatcaagaagttttttaatacgaatgagaacaaagatacaacctacaaaatctctgggacacagccaaggcagtgttaagagggaaatttatagcactaagcagccatatcaaaaatttagagagatcccaaattaacaacctaatatcaccactaaaataactagagaagagagagcaaaccaacccaaaagctgacagaaaacaagaaatagccaaaatcagagctgaactgaaggtgattgagacacaaaaacaccatccaaaagatgaatgaaaccaggagttgattttttgaaaaaattagtaagataaataggctgctagctagagaaatacagaagaaaagagagaagatccaaataaacacaattagaaatgacaaagggggtggtaccactgaccccacagaaatacaaccatcagagactactatgaacacctctttacacacaaactagaaaacctagaagagatggataaattcctgtacacataacccctcccaagactgaaccaggaagacatggattccctgaatagaccaataagaagctccaaaacggaatctgtaataaatagcccaccaaccaaaataaataaataaaaataaagcccaggaccagatggattcacagccacatcctaccagatgtacaaagaagagctggtactatttatactgaaagtagtattacaaaaaactgaagaggaaggactgaaagtattacaaaaaaatgaggaggaaggactcctcccccaacccatactatgaggccagcatcattctgataccaaaacgtagcagagacacaagaaaaaaacaaaacctcaagccaatatccttgatgaaaattgatgcaaaaatcctcaacaaaatacttgcaaaccaaattcagcagcacatctaaaaggcaatccaccatgatcaaataggcttcatccctaggttgcaagtttggttcaacatatgcaaatcagtcaacctgattcatcacataaacagaactaaagacaaaagccacatgattatctcaatagatgcagaaaaaggcttttgataaaattcaacatcccttcatgttaaaaactcaataaactaggtattgaaggaacatacctcaaaataataagaaccatctaggagaaacccacagccaacatcacactgaatgggcaaaagctggaagcattccccttgaaaacgggcacaagacaaggatgccctctctcaccactcctatttaacatagtattggaagtcttgaccacagtaatcaggaaagagaaagaaataaagggcatccaaataggaagagaggaggtcaaactatccctgtttgcagacatgattctatatctagaaaaccccgaagtctcggcccgaaagctccttaagctaataagtaacttcagcagagtttcaggatacaaaatcaatgaacagaaataactagcattcctatacactaacacagccaaaacaagagccaaaccaggaacacaatcccatttacaattgccacaaaaagaataaaatacctaggaatatagctaatcagggaggttaaagacctctacaatgagaattacaaaacactgctcaaagaaagcagagatgacacaaacaaatggaaaaacattctgtgctcatggataggaagaatcaatatcattaaaatggtcatactgcccaaggcaatttatagattcagtgttattcctaacaaactaccaatgaaattcatcacaaaactagaaaaagctattttaaaattcatatggaaccaaaaaagagcctgagtagccaaggcaatcctaagcaaaaagaacaaagctggaggcatcatattacctgatttcaaagtatactgcagaactgcagtaacaaaatatcatggtactggtacaaaaacagacacatagaccaatgggacagaatagagagcccagaaataagaccacatgcctacaaccatttgatctttgacaaagccaacaaaaacaagcccattaatggggaaaggactccctattcaataaatggtggtgggataactggctagccatatgtagaagattaaaactggatcccttccttacaccatatacaaaaatcaactaaagatggtttaaagacttaaatgtaaaacccaaaactataaaaactctggaagacaactgagtcaataccattctggatatagatactggcaaagatttcatgacaaagatgccaaaagcaatcataacaaaagcaaaacttgacaaatgggatgtaattatactaaagagcttctgcacagcaaaataaactatcagcagagtaaacagacaacctatggaaagggagaaaatttttgcaaactatgcatctgataaaggcctaatatccagcacctacaaggaacttaaattgacaagaaaaaacaaacataaaaaagtgggcaaaggatatgaacagacaatttgcaaaagaagacatacatatgggcaacaatcatatgaaaaacagctcagcatcactgatcattagcgaaatgcaagtcaaaaccacaatgaaacaccatctaacaccagtcagaatggctgctgttaaaaaggcaaaaaataacagatgctggcgatgttggggagaaaaagaaacacttatacactgttggtgggagtgtaaattagttcggtcattgtggtagacagtgtggtgattcctcaaagacctaaaaatagaaataccatctgacccagcaatcccattactgggtatatatccaaaggaatataagtcattctcttataaagccacatgcgtgtgtatgtttattgcagcactatttacaatagcaaagacatagaatcaacctaaatatccaccaatgatagattggataaagaaaatatggtacatatacaccatggaatactatgcagccataaaaagaatgagattgtgtcctttgcagggacatggatggaactggagaccattatccttagccacaggaacagaaaaccaaatattgttatgttctcacttataagtgggagctaactgatgagaacacatgggcacatagaggggaacaacacacactggggcctgtcagagggtggagggtgggcggagggagaggatcagaaaaacaactaatgggtactaggcttaatacctgagtaatgaaataacctgtacaacaaacccctttgttacatgcttacctatgtaacaaacctgcacttgtaccactaaacttaaaaaataaataaatgaaaaaaaatcacagctagtgaagtagtgaggctaggactcatttctataagtagtatttagatttgaatccagattctattttactatatagtttgggctctatcttatatgtccatagtggaaaagtaataaatgattatcatagtttttctaagagaaaaggcaaagaaaagaagatgtagtatatatacatcatggaatactatgcagctataaaaaagactgaggtaatgttttttgcagagacatggatggagctggagtcaaactaacataggaacagaaaaccaaatactgtcacttataagtgggagatgaatgacgagaacacatggacataaagaggagaacaacagatactggggcctacctgatggtggagggtgggagaaggaagaaaatcagaaaaaaatagtaattgggtactaggcctagtacctgggtgatgaaataatctgtacaacaaactccatgacacaaatttacctatatgacaaacctgcacatgtacccctgaacctaagataaaagttgttttttaaaaaagaaacaaaatattacccacacctcaaaattacccatcatgaccccttccaatcatatgccccaaagataatgatctttttgtctttcatacgcttttgaacttttcttaaagagaatcagagagtatatacttttatgcctggcttccttcactaaacattatatttttaagtaccatccatattgtagttcattctctttgctctgtagtgatcaattgtgtaaatataccacaagttatttattctactgtcgataggttttgggtaatttccctgtttaagatattacaaatagaatgaatatgaatgttttttaacacgtgaatgaatgctatttagctatgaatactgctcttcttttccatgtgatttgagaaaagaaattattacattggtagagatataactcaccattaataatattatggtttaaggtttacatgtgatttaatcttattgatttgtaattatgattttagaatttttatctaaaactcagagatgttggaaattgtttatatcaaattggtaagaaaatttctattgataggaactttttctttttctcacttttataaagaatatccacttagcatccatgagtagatatgaaaggtgagtccaatacaggaagtgtctttgttgcctgagcataaggtatctaggcaaaatagcacaggaagatacaacttaatggtatcgtgaaataatttagattgaactccattatgattcattttatctaaatatttttaacaattatttttcatgtaaagctgtacatatagggcacattttactcctatatattactatatatattttttgaaaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatgtaaaagataaactttcaatatgattatgttaaggtgaaatataatactgttagtactggtttcattacttttgcccagaacaagatttttaatatagtagtattttttaatttttttacttataagtcactataactgaaatattgcttgggttacaaataatacagtaacttgttctaattctatcatcctaaagcaacaaactgcattcagttttaaatgaacatattttatttagttttatataaaatatattattttctattctgatattttcttttgcgtatgtgaaggtatagagaatatgtgcatgttactaaaaacaatgaaaacaatgtatttataatggcaatatagttttgttcttaaatttcaaaatttaggcttttaaggaaaagaaacacctatttcttttgaaaaattatcctggtaataaatgccaatataaggatatggttttttttcctcttaccctttgatacctgtaactactaaaatgaaaataatagactttggatttgtgtagtaatttggaaatataatacttttattcataaaagtaatataagaagattaataagtcttacacccaggagttatgtttttagtttttgaagataacattctagaaagagaaattagaagggcagataagactatatttaagaataaccattatagaaaatagtactgacttttttaaatgtttaatcctaagtgttctcattgtaatatatattttacagtatttataaaagataaaataaagttgttgtttccctgtatgtacagattgaacaggaagtatcactggacctgattttagtagaagagtatgactcattaatagaaaagatgagcaactggaattttccaatttttgaacttgtagaaaagatgggagagaaatcaggaaggattctcagtcaggtttgctttcaaatatctactttttaactgtaaattaatttttcttaaatctttataaaaagcaaaatctaatatgtaatggtttaagcactagttcaacaatgacattgttcattatttttttcagaaaaaaataaatatatacataaaacaattatatataagatgtagatcatactattatatatatgacaagtagtttatttgaccatattaatgggatttaatttatgccaaagaaataataaagatttacattttcttgaatgtggaggttgaaaaggatatgaaaatatcatctagttctaaccattgcaatttaagcttcatttttttcacctgcactccctatactttacccaaggccggatgattcatttcatgctagaaccatgggaaagtactttgattttaccacccagactcagggttatacctgatgggtccgcataacagcatcagattaactgccccaaaatattactctcattaattactttcatatcttatttatgaaatgcaaaaacgtaaggataaattttgtgaaatatataagttcatttaattgaagttcttagggataaaaatgtgataaacttagtattgttttgaattttgtttttaatacccaggactagattagaatagaattcacatgaccttcagtaaattaggaataaaaagctaaggagaagaatggaaaaattaaaaattgggacatgatatgtatggtaagccttctttaattttcagtggctttagggtgacatcttccattctgatttttttgaaagaattaattgtaggcaagttttaaataaattattaaagacgtatattaatacatggttaacattccagaatacaaatcacaaaaacattatactcagctacaaatagaaattctgatttttaaagtaaactttattttaattgacatttaggttatgtataccttatttcaagacactggtttattggaaatatttaaaattcccactcaacaatttatgaactattttcgtgcattagaaaatggctatcgagacattccttgtaagtattaacatattttattatttaagttcaaataatatgggttttgaaactctttatcatctttctcttcagatggtcccttaaacacttttaaaactgcttgtttgaaattttcttttttttttttcttgagacaagagtcttgatcttgtcgtccaggctggagtgcaatggcgcgatcttggcccactgcaacctccgccccccacgttcaagtgattctcctgtcttggccctcgcaggtagctgggattacaggtgcccgccaccacacccagctaattttttatatttttagtagagatggggtttcaccatgttggccaggctggtgctgaactcctgacctctggtgatccacctgccttggcctcccaaagtgctgcgattatagacgtcagctgccgcgcctggcctgaaaaatttttaaatggagttttaaaaagaatatttgtattatactacctagatttaactgactactgttaacattttgtctgttttttgttaacattttggtatatattctccaagagttcttacataaatttattttttgtaaaggtggtcataatattgatacatatttatgatctgctttttcacctggttgttatacagtatacatctttctatttttaaaattaattgcctgtgtactttatctttttaaaagttagtcaagagtttcagaaaatcattcacttaaaaatgcttaaaattgatcatctaatttcagtttttaactgtgttctgatttatggaataatttaatggctattatatattatgtttgaatataatttgagtttcatattagaaaaagatggactgtctttatatattgtctacagtttccctccatgtggacacatttttgagaaattaattctataaatagtgaattattcttcaattggcataactcactaataatgtttaataatttaagatgagttacatatactataatttccacttatatattgtgcattcaaaaaagtggttggattttataaatggaatatagggatactttaagatggacttcaagggaaatggaacgaaaagaaagaggtggtaaggagtcttcactgtcagcttcagttaggatacattagttaagaaaatagtctctggacctaacttttctaaactttaaaaatttgtgaatgagaataacaatagtacctactccataggtagtactaatataagataattaatgtaaagcacgtatcagaattcatgacacttagtaaattgttagtaaaaggtggtgatttattaataataattaagttcccagtgtacgccatgtcatatctataggcaaaacaatattattttatctactaatgcatacatacacattaaatatttgttgaagtgttaaatttttattggatatcgacattaactgcaatcattagattcacataggttatcttattcaatcttttttggcaaagttgtattatctaacttttataggtgagaagtaaactcagaaggatctttcccaagattataaaactagataccaaagtagtgtttcagttttaggtctatctgagttctgaagcctatactctttacactatgccacattgccttttcacatagttgaatttcaggaaatagatgttttattgatcatatatgatgtgtcagacactgtgctggatgctttcacatatttagtatttaattcctgtggcaagcctgagacatagtatttctgacctttttgtgggggacacaaatgtaagtaaccagaatttgtaactgttctgtgtacaaaactgttttgtgtgcaaacatgggtctctgtaatccagacactacatgatatttttgaaagccagaaaatagccaccttgagaacattttccaatgcctttcaatactccttggttatcctgccttttctttggcacctttactatgttttcatagtatatgggaaagtttttaaaagatattttttttaatacatcaagagactttagatgaaataaaattcaattgtggggaattagtctgtcacatcttttttatgaggatatagtatgactaggaaattattgtactttttaaatgttgtgtgttaaacctaacagaaaaacgttttggtgactttagatcacaatcgtatacatgccacagatgtgctacatgcagtttggtatctgacaacacggccagttcctggcttacagcagatccacaatggttgtggaacaggaaatgaaacaggtacttccttctacaaatctcttaattattttgatcaggaatagtaaatcaagctttctcatttcattacctctgttcttttaagtttttcattaagtaaccgtttagtacatacgaaggactgtgtacgtttttttaaccacttatccccaagttctactgtgtaagttttgatgcataataatgacatgaaaaattttaaacctgatacccatcttaaagatagattaatattcagtactgctggatctatcatgtttccttctttcccccattcttttgttttcctcactgaggtagccactatcccgaatattatgataattagtcctttgtttttttaaaaaaaattttttttttgtttcaagtacatcacatacatttaaaatacataacattcaaaaaccaaagagaacattttcaaaagccttgcaaagtatttcaatgatgacattaaaaacttttataaacaaattttgcttccaaaaaagttaatgctattccttatcataaatataatagtttatataaatacaatgaatcataacatttatagttctcttattctagcttattaaaagggccaggcctggtgactcatgcctataatctagcacttctacaggcttaggcaagaggatcacttgaggccaggagtttgaaaccagcctaggcaacaaagcaagaccccatctctacaaaaaaatttttaaaaaatttagctggatgtggtgacacacacctgtcctagctactcagaaggctgaggtgggaggatctcttgagcccaggagttcaaggctgcagtgagccatgattatgtcattgcactgacatatatcaagacagaatttgctcagttaccaatacttgagaaataacattaccatactaaccagtgtaaatgtcatagactcaaccactgatattactttttacattttggtagttgagtctaaagtatgcattatttgtttaatggatttgctttatgtcactggttcatttttgtctgccatctgtatttattctttctagtgcccttcattccttccaccagtcctgtgcttttattagagataattttcttcaacttttttgttttagctgtcattttgtcttagaagaatatatttatattttagcatgtttgaaggtattattccataatcttgtgactttcacagtttttgctgacaagtcaagacttaggtcatattgagaaatataatatataaatataatatgttcctttttctctttcctattggtttttagcattttaactatgatgtactcatgtaatttttttttgtattaatcctgcctgatgtttagtgaaccttttgaatatgttgattggtagttttttactggtttctatcatgctcttcaaaattcagcctctccattgtctaattccaaagccgctcccacatttttaggtgtttgtcacatcagtacctcacttctaggtgccaaaagtctgtattagtttcctattgctgctgtaataagttaccagaaatttagtcactgaaaaccacacaaatttattatcttacagttctggaggtcagaagtccaaaaaaggcttcactggagtaaaatcaaggcatcaacagaactatttttctcctatatactctagaggagaatttgtttccttgcctcctccaattacactccttggctcatggccctttctttctttctttctttgtttattttggagacggtgtctcactcagtcacccaggccagagtacagtggcttgatctcggctcaccgcaacctccgcctcctaggcgggttcaagcaattctcctgcctcagtctcccaagcagctgggactacagatgcacgctgccatgcctggctaatttttcgtattttagtagagatggggtttcaccatgttgcccaggctggtctggaactcctgagctcaggcaatccgcccacctcagcctctcaaagtgttaggattacaggcgtgagccactgtgtctggccggcccattctttaaagacagcagcataacatcttcaaatttctttttgaccctgaccttttgatctttccaaggaactagtgaaaatcaatccagctctgcaaccttggctttctgtgcagaacacacttaactgacagtgactctcttaattttagtctctcttgtagtctggataggctgagaatttcctgaattatcaagtccttattcctctttgcttacgagttctcccccaatctttctttttcctctcatatttactataaacagtaagaaaccagactacaccttcaatgctttgcttggaaatttcctcaactaaatgtctaagttatcatttgtaagttttgtattccacataactgcaacacctaattcagccaaattttctgttactgtgtaacacggattcccttgcctctagtttccaataacatgtttctcatttccttctgagcattcattggcaatgaccttaatgaccatttttctatctccagtctgttctcaatgacttaggtatagtattctctaagacaatatatgttttctctctcatgctgcacacttccttctgagttcttactagcagtgttatgagttctcatacatagtgttatggagccaagtatctgtagaagaaaggaaaccaagtagctttgggaaaccaaatagctattgcaatggaaaattatgatgaaaactaagacaagaaggaccatgggatgtgctgtcctattctcactgcactggagaactaatggaaaataaatgacaagtttagggctgtaattaatggttggagaaccaggtagcatctctgactgacctaaaagaaacccttattttttttttaatttattttattttattttttttttgagacggagtctcactttgtcgcccaggctggagtgcagtggcgcgatctcggctcagtgcaagcgccgcctcctgggttcatgcgattctcctgcctcagcctcccgagtagctgggaccacaggcgccctgccaccatggccggctaattttttgtatttttagtggagacgggttttcaccgtgttagccaggatggtctcgatctcccgacctcgtgatttgcccgcctcggcctcccaaagtgctgggattataggtgtgagccactgtgcccggccaagaaacccttattttttatagtaataggatcataacttctgaaaataaaacccaatgtctgatcctgaagttgcttgaaatacaatgcaaatgagtttgtggcctcagtagacttcttatgttagaattaagatatcaaatgggaaataaaggatcctgataatcaaaaagagatcatttggatagatttaaataaatgttgccttgtattccccaaatcctgctgattcttcatgctgggaagcagtcatttctccttgtgttgattgcctgaaaaccctgtaattacctcacttgagattcttgatttatagggaaataattcacttctaaatccaactccactgtcactcatttctttgagatccataattaaacttaaatcctgcagatcttaggggaataagtattaagtctgaacaccagaataatttaccaattcatattggtagaaacctgggggatatatgtctgaatagacttaagggtgttagaccagggagaaaggaagatgtacctaccagagattctggagtcagtgtattagcttgagcaactggcagtggctctaacagtttgcctcatgagttgtctaaagtataggcatcagatgaagtagaattgttgaaactccttgtatactgtagaggaaggaatccagaagctcacaatgttaagatgttgaaatggggtgatcatattcaattttatcacccatccctaattttatccccaagaagtatcctcctttatcacagtggtgagaaatatatttcagcattaattcctggagagtgaaatgctatgctggtcctacagccagagttaggggcctatggaatttaggtgataaaaggattttggcctgggttcatctcataatggtagttagcagaaccacacccattttctgaatgtatagtttgagtaaacatattcagcaactgtcagaatcccttcatcaattccttgatctttggaaagaggaccatcgttgtaggaaggatcaaatggaatctccaggaattgcctcattctggcaaaacagtgaaccaaaagcagtataccacattcctagatgagttgcagaaatcagtgctactagcaaatacttaatagatgcaggaatggtgatttccatcacattgctgttcaacttaattatatagcttttacacaggataagtagatcctggaaaatgatggtggattattctcaatgtaatcaggtggttactctagttgctacagctgttccagatgtggtctcttcttttaataagttaacctaacttgtgatatttggcacagagcaattgatctggagagttgtttttcctccataactcatagcaaaattcacaagaagacatatatttacatctggcaggcatcacaatacacttctattgtcttagttctgggctatgtcaagtctttcattctctgttataatctagtctgttcccgtaagttatcaaggtcagccattacattgatgagataatgatgaatagctccattgagcaagaagtaacagatatcctagatgccttcataagagtgccagaagatgagagatgagaaaaattgctaaaaaattcagagatctgtcatatcattgaagtatactagggatccagtggtctaggacatgttgagatatttcctccgagttgagggataactgatacatttgaaattctctacataaagggctctttggattctgaaggcaaattcatgacttctgagtactattgctccaaaatactactgtaaggctgtatgtgcaacccagagcaagagaagcatgtgaagcaatttctactcgttgtgcaaattactctgccatttttccatctgactgccaaaagaaaatgtcttttgcagatagagatcccctttggagtctctagaagaccactacaagataattacagtgtaaatacatggagttttgaaacaaaaccaggcagctttcctcaaataattattttcctttctgtaaaagcagctaaattgttgttgcactttggtagaatctgaatacttggccatgggcactagattaccatgttacctgcccataatgaatttggggccctctgatcctccagttcataaatttgtcatgtgcagtagttctcaatcatcaaggggaagaattacttacaagattagttttgagttgctcctaaaagcacagaatgtaagttcagacttccatgacatttattcctaatacaccaatacctcttccttaatccatagttacggctttgtggggaattccctatgaccagttgacttaaagagaaagaccagttgccctggtttataaatagttctgcccaatatgccagtacttcctcaaagtggatagctacagcattgtaggatcactcaaaggtatcttttgaaaggtaataaggtaaatccttccagtgagcaggtcaagcggtgaatcagttggtcaagaaagagacatggccagctgaaaggatctgtactgatttatgatcagtagctaagagcttccttggatgctttgggacttagaaggaaaaatattttaaaattggagtttttaattggacaaggtgttttagttagggggtttatggctaaccttcccagagtggaaggtggatatttgtttgcgatgtgaatgcttactatgatgcttaattttacatgtcagcttggctgggcagtagtacctacatatttggtcagacattaattttaatatttccttcagggtattttttggatgagattaacatttaaattgatggactttaagtaaagcagataaccctccataaggtcggtgggcctcatccagtcagttgaaggccttaatagaaacaaagagtgacctcctctgagcaaacaggaattccaccagtagacagccttcagacttgaactggaatatcagctcttccttgggtctttagccaatcagcccaccctgcagattttggatttgccagcctccttaatttcatgagcaagttccttaaaataaatctctctctctctccctctctctctctctctatatatatatataaaatatatatatgaattatatatattcatatatatatatgaataaccctcactaatatataatatttgccaaaggccattcactgcaaagaaggctcttgatgatcaggtggacaaaatgatctcttatcttatagcgatcagtctctttccctatgaactccagttcttattccgtgggtttatgcacacaacagctaagtgtattagtctgttctgacattgctataaggaaatacctgagactgagtaatttgtgaaggaaagaggcttaattgagtcacaattctgcggctgtacaggaggcatggctggagaggcctcaggaaacttacaatcatggctaaaggtgaagggaaagaaaacaccatgtttctcaggctggtctagaactcctgagctcaagtgatccacctgcctcggcctcccaaagtggtgggattataggcatgagccaccgtgcctggcccatgctgttttgattactatcgctttgtaatagattttgaaatcaggtagtctgatgcctccagctttgttctttttgctcaagattgctttggctacttggaatgtttttgtggtgccatatgaatttttttttctatttctctaaaaatgtcattttttttgttgctaagtatgtagaaatgcaattgatttttgcatgtttatcttgttccctgctaacttgatgaactaatttattagttctaatagtttttcagtagatttcttgggatttcctacatatacgagattaggccatctgtgaataaagatagttttgcatcttcatttccaatctggatgtcttttactgaggcgtccttttaaatgtgtcagcaaatttttaaaatcacagttttctgaaacgaagtgaataaatgggattctaagtagttatgtttcattgcccttgccaactgtgttcttttttgtactgttatttttttggaaacatatataagctaatgttttaagatcctaatatataaattccaagtaattactgaatttaaaaggaaatattttgccatgtttgatttttaaaatatattttaaaattgtagggaaagtccagaatgtgtatcacataggaaaattcaaattattgactctgtattgatatttaaagtcttattagaaatttgagtgcttacatatatcattatgcatataatttaactgcctcatgtttgctttttataattatttaaaaaatagctctaagccggtgtagtggtacataactctagtccaagctactcaggtggctgagggcaggtcaattgagatgaggaattagagggtgtagcgtactattacgattggacctatgaatagctagctgctgcactccaacctgggcatcatagcaagaccccatctctaaaaacataaattttaaaaaaatgctctagtgtgggctattccaaaacttaattttgatacaaattataaatagcatgaaaataatgagatatatttataattgtcactagtgtattaaagtcatgttaaaaaattcttgtgatggtgtattgagtcaactaaaataggattaaataattcttttggactttaacaagccagagcattatttctaggttcccccaatgaatacaaccaaggaaactttgtacctaatatctgtggttttatgtgtctactttaaatatagtttctttttccttcttatactttttaaaggtttcttttgcaaaaataatagaatgatcatctagatagataaagccaccaaaaaagaagaaatcaatggtaagatattaagacaccagaagcacagtgtggatagtgaacatattgtttctaagaagaggataaaaatagagttatgttgactgagatgttccccagttttccatgccttttcattttccactattttttattccgttatattatatggagcttcatgaaagaaaacaaaagggagataaggagttgtagttagggctacaaatgaaatgtaatctttccggatgagatttgaaaagcatctatgtagagaagcttagtttggtaagatattaaattcctaaatctttgtaatgttttcatcaaattttattctctagtattgcctttttctgttatatcatatatcctggccattgtatctatctagtcattaaacagcaaatatttagaaaatcagaggtttttaaaattattatttgcctgagtaagcatcaaacttgtgtgagaatcctatcacgtcttgtaaagtaagcaacttcagggtcagatttaacactgttcctctctactaacatgttaaattgggaataatatactcttttaagttcatagattttagttcttacttaaatcagcaaataaaataagtaagcatattacctatgagaatcccctccatagcaaaattgtgaggaatttatgtgctaatgctggtttattttgctatttattgtttctcagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggtaggaaatatttttaagaacctttaaagagtaattctgaaattttcagtcatgctgtgtatccctttataaatcattcagttgaatcatatgtccaatccatctgactttaataccctacattttaattaattggataacacatggcattaatgtgatgtgtgctaggaaattaggggaagaatcaacttcttgaactagaaaataatagacagtttttgaaacaactcattgttttgtgaaattctagagtccttgctgtcaatatttttgtctttaatcaaaccagcaaaactctgactgtatttaagatttctgttccgctggagccaagatggccgaataggaacagctctggtctacagctcccagcgtgagtgacgcagaagacgggtgatttctgcatttccatcggaggtaccaggttcatctcactagggagtgccagacagtgggcacaggacagtgggtgcagcgcaccgtgcgcgagccgaagcagggcgaggcattgcctcactcgggaagcacaaggggtcagggagttccctttcctagtcaaagaaaggggtgacagacagcacctggaaaatcaggtcactcccaccccagtactacgcttttccgacgggcttaaaaaacggcgcaccaggagattacatcccgcacctggctcggagggtcctatggccacggagtctcgctgattgctagcacagcagtctgagatcaaactgcaaggcagcagcaaggctggggaaagggcgcccgccattgcccaggcttgcttaggtaaacaaagcagctgggaagctcgaactgggtggagccaaccacagcccaaggaggcctgcctgcctctgtaggctccacctctgggggcagggcacagacaaacaaaaagacagcagtaacctctgcagacttaaatgtccccgtctgacagctttgaagagagcagtggttctcccagcacgcagctggagatctgagaacgggcagactgcctcctcaagtgggtccctgacccctgacccccgagcagcctaactgggaggcaccccctagtaggggcagactgacacctcacacggctgggtactcctccgagacaaaacttccagaggaacgatcagacagcagcgttcacggttcacgaaaatctgctgttctgcagccaccgctgctggtacccaggcaaacagggtctggagtgcacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagaacgcctctcctcctccaaaggaactcagctcctcaccagcaatggaacaaagctggacggagaatgactttgacgagttgagagaagaaggcttcagacgatcaaattactctgagctacaggaggaaattcaaaccaaaggcaaagaagttgaaaactttgaaaaaaatttagaagaatgtataactagaataaccaatacagagaagtgcttaaaggagctgatggagctgaaagccaaggctcgaaaactacgtgaagaatgcagaagcctcaggagccgatgtgatcaaccggaagaaagggtttcggtgatggaagatgaaacgaatgaaatgaagcaagaagggaagtttagagaacaaagaataaaaagaaacaaacaaagcctccaagaaatatgggactatgtgaaaagaccaaatctatgtctgactggtatacctgaaagtgagggggagaatggaaccaagatggaaaacactctgtaggatattatccaggagaacttccccaatctagcaaggcaggccaacattcagattcaggaaatacagagaacgccacaaagatactcctcgagaagagcaactccaagactcataactgtcagattcaccaaagttgaaatgaaggaaaaaaatgttaagggcagccagagagaaagattgggttaccacaaagggaagcccatcagactaacagcggatctctcagcagaaactctacaagccagaagagagtgggggccaatattcaacattcttaaagaaaagaattttcaacccagaatttcatatccagccaaactaagcttcataagtaaaggagaaataaaatactttacagacaagcaaatgctgagagattttgtcaccaccaggcctgccctaaaagagctcctgaaggaagcactaaacatggaaaggaacaactggtaccagccactgcaaaatcatgccaaattgtaaagaccatcgaggctaggaagaaactgcatcaactaatgagcaaaataactagctaacatcataatgacaggatcaaattcacacataacaatattaactttaaatgtaaatggactaaatgctccaattaaaagatacagactggcaaattggataaagagtcaagacccatcagtgtgctgtattcaggaaacccatctcatgtgcagagacacacataggctcaaaataaaaggatggaggaagatctaccaagcaaatgaaaaacaaaaaaaggcaggggttgcaattctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtaacctacaaagagacttagactcccacacaataataatgggggactttaacaccccactgtcaacattagacagatcaatgagacagaaagttaacaaggatacccaggaattgaactcagctctgcaccaagcggacctaatagacatctacagaactctccaccccaaatcaacagaatatacatttttttcagcaccagaccactcctattccaaaattgaccatatagttggaagtaaagctctcctcagcaaatgtaaaagatcagaaattatggcaaactgtctctcagaccacagtgcaatcaaactggaactcaggattaagacactcactcaaaaccgctcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccagaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaagagagaagaatcaaatagacgcaataaaaaatgataaaggggatatcaccaccgatcccacagaaatacaaactgccatcagagaatagtacaaacagctctaagcaaataaactagaaaatctagaagaaatggatacattcctcgacacatacaccctcccaagactaaaccaggaagaagttgactctctgaacagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggattcctccccaactcattttatgaggccagcatcatcctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttcgggccagggcaattaggcaggagaaggaaataaagggcattcaattaggaaaagaggaagtcaaattgtccctgtttgcagatgacatgattgtatatctagaaaaccccattgtctcagcccaaaatctccttaagctgataagcaacttcagcaaagtctgaggacacaaaatcaatgtacagaaatcacaagcattcttatacaccaataacagacaaacacagagccaaatcatgagtgaactcccattcacaattgctacaaagaggataaaatacctagcaatccaacttacaagggatgtgaaggacctcttcaaggagaactacaaaccactgctcaatgaaataaaagaggatacaaacaaatggaagaacattccatgctcatgggtaggaagaatcagtatgaaaatggccttactgcccaaggtaatttatagattcaatgccatccccatcaagctaccaatgactttcttcccagaattggaaaaaactactttaaagttcatatggaaccaaaaaagagcctgcatcgccaagtcaatcctaagccaaaagaacaaagctggaggcatcacgctacctgacttcaaactatactacaaggctacactaaccaaaacagcatggtactggtaccaaaacagagatatagatcaatggaacagaacagagccctcagaaataacgctgcatatctacaactatctgatctttgacaaacctgagaaaaacaagcaatggggaaaggattccctgtttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggagataggcatgggcaaggacttcatgtctaaaacaccagaagcaatggcaacaaaagccaaaattgacaaatgggatctaattaaactcaagagcttctgcacagcaaaagaaactaccatcagagtgaacaggcaacctacaaaatgggagaaaattttcgcaacctactcatctgacaaaggattaatatccagaatctacaatgaactcaaacaaatttacaagaaaaaaacacacaaccccatcaacaagtgggcgaaggacatgaacagacacttctcaaaagaagacatttatgcagccaaaaaacacgtgaaaaaatgctcaccatcactggccatccgagaaatgcaaatcagaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacctagccatcccattactgggtatatacccaaaggactataaatcatgctgctataaagacacatgcacacgtatgtttattgcggcattattcacaatagcaaagacttggaaccgacccaaatgtccaacaatgatagactggatgaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcagtcataggtaggaattgaacaatgagaacacatggacacaggaaggggaacatcacactctggggactgttgtagggtgggggaaggggggagggatagctttaggagatatacctaatgctaaatgacaagttaatgggtgcagcacaccagcatggcacatgtatacatatgtaactaacctgcacattgtgcacatgtaccctaaaacttaaagtataataataataaaattaaaaaaaaaagatttctgctcctcctatttaggcccattgtatggctagaaagctataatggttgagaactattaatcttttttgttgttctcttttttcccttaagatttgccttaataccagagctaaaatctcttacttctgaatatattagtgtatgtaaaaattcttctggtatattatttttgtacctagtatagctggtaaaatataaaattcctttaaggtcacaatttgcatgaaagaggcaagagttctcaacaaatagatactgtaattgcaatagctttaaacattaggacttggaactaaatatgtgttgtgttttgctttgttttgttttttgagacggagtcctgctctgtcacccaggctggagtgcagtggggcattctcggcttactgcaagctccgccccccaggttcatgccattatcctgcctcagtctttggagtagctgggactaccacacccagctatttttttttttttttttttttttagtagagacggggtttcactgtgttagccgggatggtctcgatctcttgacctcgtgatccgtctgccttggcctcccaaagtgctgggattacaggcgtgagccaccacgcctggccctaaatacgtggttttaagtagaatttagtgtggttgtggtttaagcagatttttgtgtggtagctgggtttgtttatgctggggattcctgaaatgtgatctgtgtgtttctaattggatgctttatgaagagtaggtgctcagtgatagttgctgaattcatctcacttcccacttctttattctatgtttaaaccttggctctgatcctttcattttctgtagccattttctgtttttcttttttttcttcaatctctttcatatactccaacttttttaaaaataggagatatattctcttgaattgtgagcatgtgtgttggggtcgggggaaggcatgtagggaactatgaatatgtatatgtgtaaatgggtataatggggtgtgtgtgtgtgtgtgtgtgtgtgttaatgggttaaaagggccatgtgattcatttatccaatgagactttattaatagctcatgatttccagaggtaactttctgattaatttaaatctagttactagtagttgcccactttctaagtattatttttttaaaaaagtaccttctaagtggcacatattttcttatttgcaataccattctgtaagaatcagatgcccattctctcaaacctagcacatcataatctttgaaaatcctagtcctttggtgaatcatagacctgaggattaatggcatagtggaaaaagcactggacgagattaaaagtcctgtcttagatttctgattgcccacttattagctgtatgacctcaaataaaggtttattcctctgaacctaaaaatagttatctgatatgattaaggaggtaacatatggaaggttttatactgtttctgatggcatgagaagctcctgaatcagaaatcacataggtagaagttacttactgttctagtccactctgctgttttgttttgctttgttttgttttgagacagagtcttgctgtgttgcccaggctggagtgcagtgacgtgatcttggcccactgcaacctccatctcctggattcaagtgattctcctgcctcagcctcccaagtagctgggattacaggtgcctgccaccatgcccggctaattttttatttgtagtagagacagggtttcaccatgttgaccaggctggtctcaaactactgacctcatgtgatctgtccgcctcagcctcccaaagtgctgggattacaggcatgagctaccatgccggcctactctatgtttttattacagctttcattttcgtaaagtatatcttccctcaaggatgttagaaatgagtgaattccaatgttaactgtctcacatgaagataatttaaaacaatgttatatgaacaacttatacaagttgcatactcaattgttgtcctaatcaaaatacagttgtgaagtctgaacatgatatcaataatcacgttatttctaacttctcattgttacgaattgccattagatgaagccataggaagtgctagaatggaaaggagatggattagagagttcagctgtgaaaatgcatagcctcttacctagtctccttgcttgttgtctgctctccttcagtctgttctcaacatgtcagccagaatgtgaccctgtttcagtgtgttgcatcactctgttccagactcttttgccaggcgctgtggctcacacctgtaatctcagtgctttgggtggctgagacatgaggattgcttgagcctaggagtttgagaccaatctgggcaacatttgagaccctgtttcaaaaaaataaaaacaaaatagtaaactctccaatggcattcaccttacccctagtaaatgacaatcataaaatgttctgcaaggccctacattattggtcccattaagtctctctctcttttttttttttttttaacttactcaagtctagtctcactggcttccttgctaataccatctctgtccctttctgagagtgtttgcactttctgttctccctgcccagagggcttttcctttagatatccgtatacgcattttgtcacctccttccatctaaaatttcaaaatccccttctttataccattatgctccttctctgctttttttccattgcagtgatcatttaggatactatatattttgtttatgtactttgttttttatatgtatcttctcaatggaatataaagttccacaagggcagggatttttgtcttttattccataatacctagaatagtgcttgacatacaaaaagcatttagtaaatatttgttgaatgttgaaggatgtctgaattctttgctctgtagtactcctaggttttctgaaaaatgttctgtgcttcccaaagtaacgaagtttatgaggccttcttcaactagcacctgtgagataaggacccttgtaaaaatctagggcttaatgtggttaagtaacaaagtaggttctttcatctttggaaactcagtgggtctagtcaggccataattaatgaaagatattatagtttcagtgtaatatagacagtagcatataataccaccagctgggtcaagcattcttcttcattctcatggtaaggaatgtgtgctagaaagatacaggaggattcttgccacgaaagaaggtgatacatatagtcaggtatatcctggaggaatgtcagtattaataagattctaagagatttctgagctatttccaaatgagaagttggctgaaagatgcaggttagtgcttgagatagtaaaatttctggaatatttttatgagactgggtaaaaggaaacaaaattttaagttgagatttttaaatgttttgtcttccaaaatatggattaagatgactaaacacatgaatctgttaccccttcttcctgagaatgcattaaaataatagtaagttatgaagttcattacaacagagagcagtaagaggaggatgggtattatcaccagcagataaaagttttttttataacatttctggaaaatgaaaaatggatgaatattgacagataaaacaaaagtacccagcacagctggaaccccagagactcctgttaccatttgctcctgcttgctctccctgtgcatacacacacctttatgcagagtgactaaaaccctatgtttacctccaggcagaaaactcatctcttagatattgaaggaactgcctggagagagtaacagttcctggagtgggtattagtagtctaaagtaaatttctctcattctagacatctaatagctggcacccattattctaaagcaaaacttgctaggtaacaaaccctatccacatttacatagttcccactcactcatcccaaggggagagactccacaataaaacatacataacagcagagagattacaactgaaatctagaattttttttttttttttgtgagacagggtctcactctgttgccaggctggagtgcagtggcacgatcttggctcactgcaacctctgcctccagggttcaagagattctcctgcttcagcttccgagtagctgagactacaggggcatgccaccacgcccagctaatttttgtatttttagtagagatggggtttcaccatgttggccaggatggtctcgatctcttgacctcgtgatctgcccacttcagccacccaaagtgctgggattacaggcgtgagccaccgcacccagtttaaaattcatttttctatatacacagaaaaccaaggatcatcagccatggcattaatcagaagcttggaaagaaaaggctaagatggaaagaataactgtcacagggagaatctagggaatagagaagcatctaattattttttttaaaatgtattctcagaatttgaaaaatattgcatccataaagtaagaacaggaaactataataaaggaacatcagaaaacaagttaggctcttagaaactaaaaatattactgcaggaaattttaaaaattcaatataagcattggaagtagaagtccaggtagtctgtcccaggacatagaccaggaagataaaaagagaatatagggaaggagaagataagatataggggactaggtcaagatgtgactagtggaagttctaaaaagaagggagtctttggattgaaggggctcactaagtgccaggaaagttgaatagagaaaaaaattcaaacaccacacatagcacatcatggaaaaatttcagaacaccagagattttgtttaaaaaaaaaaagaattcccgagaagatgaaaacaatacatctataaaagaacaaaaattcaactgtcattgtattttagcaacaatagatgctagacaatactggaatgaagtctctaaaattctaggggaatttattcatttatttatttgttcaagtatttattgggtgcatattgtgggataggcactatttaggcattgttatattaaataaaacatgggaaaaaatcttgcccctcatcgaacttacattctagtacagcaagaaaataaatacataaataatgtgtgtgagcaagagagagagagagagacagagacagagcaagagaaagagagaccaagagagacagacagagagagaaagagaagattatgacttaagagctaggaaataagtaaaatgagaggagataggaagtgctggcataagagtattattttcaagttagagttctatattcagctaagctaccattttacatgagagcaaaataatgagattctcagatatgcagtgattttaaacagtcatatcttgaccatcctcagaaagttattttaaaatgtatttcagcagaagaagggtggtaactaagataaaggaagataagggattattagaaatttttgaactgatacggtttgtctctgtgtcctcacccaaatctcatctcaaattgtaatcctcacatgtcaagggcagggccctggtgtgaggtgattagaccatgggggcaggttctcccatgctgttcttatgatagtgagggagttgtcatgagatctgatggtttaaaagtggtagtctcccctgtgtgtgctctctctccctctcctgctgtcttgtgaagaaggtgcctgcctctccattgccttccactgtgactgtaagtttcctgaggcttccccacccatgtggaactgtgattcaattaaacctcttttgtttataaattacctagtctcaggtagtatctctatagcagtgtaaacacagaaaagaacaaaccgagaacagtgtaaaagaatcctgagataacagctgtttgtcaagactatttctttaccctataaaaaaacaacaaaactagctgctttgtgttctgtggcaccttatttatctgctatctctctactgaatttttttttgagttgggaatattattttttaaatgaacaatctttcttaatctttttcacttgaagtgccttcttagttggccaggtgtggtggctcacgcctgtaatcccagcactttgggagtctgagaagggcagatcacgaggtcaggagatagagactatcctggtaacatggtgaaaccccgactctactaaaaaacacagaaaattagctgggcgtggtggcgggcacccgtagtcccagctactcgggaggctgaggcaggagaacggcttgaacccaggaggcagagcttgcagtgagctgagatcgcgccactgcactctagcctgggcaacagaacgagagtccatctcaaaaaaaaaaaaaaaagtgccttcttagtcatgagataatggctatgacctagatttttgttaatgtttcctcctgtttcttatgttttaaaaggggacatttgttcagattagtcagacttatcctttgtatgatctaagtccttcttatgtctgaagggttttctctttttgttcttatttaagtgttactatttgctaagattctgtcagtttgtattaaaccccttctcagatctttccaactcagagggtgaaaagtaagatttatgaccaactaatttgttttgccaaagtattgatgtatttgctgtagagagaaggatctatagctagaaaaagcaggtaacaagatgctttagcacaaagtcaaaggatgttagtttattgcagctccaaatgagctgggaccctgtcttttttctctgcttctaagagcccgcagtaagagctgaggcttcattatctgtttgcttgaaatgtttttcttatttggtttaagcttggtctgctgctctgtgtgctaccttcaagtattcttctaaagtagcattgacatttgcttcctacttactgcttcatgattctttcttgcctcccactcatctttgagcttgtgagtctactggggatcagcagggaaccccttccacttactcttcatataggctttttccttcttatgcagtgacttggttagcttttctcaatccattctcattttcaccatgtctttgaagtttccagtatggtcattatatctagattctaatactgattcagaccttcccccctccgcccattttatatttctttggcaatttcaaagggtaatttgaatggtgaaagaattccgaacttgctcatttttttaaaaaactgatcttgctatctgtaagtttattaagtcagctagcttcacagggcattcattgtacattgtgttgtattgagcccagaatcagattacttcctcctgaacagacagagctgttctcatagttaagtccttgtcacatttgagcatgaattagtcaaatcattattaaatgtaaatgaccccttagggagttttcgaagcttactctttctgtttggtatttataatgtttagaagttgtattacaggtggtatgaaatgcctttatatggctcattgcaaagtttaaatcataccattgcttttataaaaccaaatagcttaaaaaataatcacttagtgttatgcatctgtgcttaaatctaggctatagctaattttcacaaataagtagagctattcaattaagctctcagaatatgtatcctacctgagatctcattccgtccttctttctcattacacagtaggctccatgaaaacagggatagggttttaatttttatccctggcctttaacacaacttggctgtagaagtttttttaataattactatgcttatttaataatttaaagaattgcttaatttgtagaggtggaagaggctttagaaattctatactccactgattttaagtctgtattccaaagtcctagagtactgaggaggcacctcagggtcttctgctggagtgaagtgtagaaaaagtgagtagttccacaccatttgaaccagaggatttgtgtttttatctgttacatagttctgttttactcccaggccctgtgtgaggatgggaatccaggatatgtccatctcagacaggcaggtctcttacttaccctggacagtactgcttcctcttctttagtcaccatcaccattgactccagaatgactaaacaacagaaatgtattctgaaacctgctctagatccctaatgactttattcacagaagtttatctgagaaggttttctgattaaatgaaatagacctcaaagtatcaactttacatctcttgggaggcagcacggtgtctgcaaagataaactttaaagatatataaccctttcacttactagagctatgtatgttggaaggaaaggtgtatcttaacctctttgtacttcagtctactcatttataaaattatcacaacctattttcacaggtactaaaatacctggtaaaatgcctagtatatagtaggtattcattgtttgtatacttccaacctgatattaaagatattaaactttaatatctttgaggtgtctgcctcatttttctatatttctttttaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggtttgttatgaaaattagtgcctgatttaaaaaatctttattgtcagtgttactgataaaatatgttttttaatgttaagttagaattattactacttaggaagtaacaataaatagttgatataaaataatatatatgcctatatttttaaaaataaacatttttattgttatggtaacatttcctaaaatattattgcttgttatattttctttcgacacataaacttatactattgtgactttatttcacatatttttcacatagaaacaaaccagttattagaaacaaaccagttatttcaaatgagtttaaagagagatttgacaaagccatgctcagtgtcaagtaaggcattatataaaattaactttatgtgtttcttaagaatccagttaattatgtctacctcactgcacctgttataccttctttatattagtgattctttagctggctagtttagggaaaaggaagcaccctcttctacttgagaataattcattcattcaacaagtatttattgggattgcccactatgtacagacattgtactaggccaaagaactcatattcaccaggggatcaagaatcactgccccagtatgacggtggtactcatgggactatgctttatccctcagacatttgaggtgaaaaaagttgagaaccactgctttagattcccaccctggcttgcaggaagctgctattttcttgatgacttttgtgacctaaaagaagctgtacctgcagggtagagaaactggtaacaaaggagtactagattagacctgctggaaggagacccttatatatgttgctgtcatgacattaatgaaatgcttataaaaatcagtgagaagtaagggtacctttaaaattatttcatagttgtatagtcttattcactttaatttttaaataaaattcatttaagtgcttaagtcaccttttataggtaaaagattatctaatacaatactttgaatgtgtattccttaaagacttctattttgaagtctctcaaaaaaatgccatatgaatggggctctagacttcctattaagtttcaatcaaaagagctcttctctcaagtgttttctatggtggtgttctacatatatatttttttttttctgaaagagtttggtgccaaaaagcaaccatcacactgaagttcaaaagctatgatgtggctcattcttttcattttttacaaaatgaaattttagttcttgaaaggctttttttcagctaataattatcatttatttaaataacaatatttaacattttccgtgaacaaggcattttttcatttattaatcctcatagcagcatggctagattggtactacttttcctacttcatagatgaagaaagttagattcgaataggttaagcagttttttcactgttacacactgaatttttgattcagaatacaacttgctgattcatgacattctgagtcaggatttaaaactatagggccagcttctcagacttgtgttcagttcactatatcatgttgcctttcacagcaagggcaaacttctctagcttcttaagtgttcttttttgaggtagaaataagtagttataattcttatatgattttttgatattgtgtatgtactatacttaataaatacatatatatatatatacacacacacacacacatataattcatgattctttgtggtaatcacaaatattgaaacccatggttagttatatgttttgctagaaagcattttttagaaaggaaatttaaccaatagaggtccatattatggaataagctgattttaaaaagaactatttgctgaaatttctttctgtcatttagacaggaaacagttttaagataatttggtaaaagcaaacaaaacaacaagttttaaaaatgccttcagaacctaaaatgatgttgtttttccaaaataggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcaggtaagttgaaacctgagcttggtgggatttttaagagctgtcatgagaagacactactctttgggttttggatagctttattaagtgtttgaaatctgagttgctttgactgggaagggttaaaaattgttgcatttgctttggttcttagtattttctgtgttctgtttgcctttgctgttaaaattttaaaaaataacttattccctatcttgactgagctgaatatactcatgagtctacaggtaaggctgttagcagccgcaaatccgagtttgcagcaacctcaattcttgccccctcagaagaaagaattcaactgaggggcataaggcagagggagagactgaaccaagttttagatcagaagtgaaagtttatttaaaagctttagagcaagaatgaaaggaagtaaagtacacttggaagaaggccaggcgggcaacctaagagatcaagtgcatggtttgacctttgacttggagtcttatacattggcatgcttccagggttgtgttacttctcccaattcatcctttgaggtggctgtcacatgtgcagtgacctgccagcacttgggaggggccacatacacagtgtgtttactgaaattgtactcatgctcacttgaggcatttttcccttaccagcccagtgttcatggaagaaggtcatataccaattaaactccaccattttgcctcttagtgcacatgcttgagcccactcacccacctcctgagatcttaccaggaagctgctgatcaccagtttctgttgggtgactgcctttccctggtgccagctgtgaccaattattattttagagagacagcttaacctatcacctgatggtcacctgacatttctgatggggttgggggtgggccctctcctgctctgcccatgtctgcctgactactttctataacaagtctagactacattatgattccaaggtctctttcaaccctgagattctgtaacctagaagaatttatttccagatgaagtggtttttaagttattcagggtgtgctcagaatatatttaaagaatatcaatccattttcaattctgctataaaaagactaactccctgcagtaggaacatcaactgggaagaaatccggacagagggctacaaaatggagagaatagacacttagtggttctcaaggattcaaagatataagcaggctcttttgttcttaaatctttttttgagacagaggctttctctgttgcccaggctgtagtgcagtggcgcgatctcggctcactgcaacctctgccacctgggttcaagcaattctcttgcttcagcctcctgagtagctgggattacaggtgcacgccaccatgcctggctaatttttgtatttttagtagagatggggtttcaccatgttggtcaggctggtctcgaactcctgaccttgtgatccgcccacctcggcctcccaaagtgttgggattacagacataagccactgtgcccggctgttcttaaatctttaatttttttttaaattattctttaagttctgggacacatgtgcagaaggtgcagttttgttatataggtatacacgtgccatggtggtttgctgcacccatcaacctgtcatctacattaggtatttctcctaatgctatccctcctctagccccctaccccctaacaggcccccatgtgtgatattcccctccctgtgtccacgtgttctcattgttcaactcccacttatgagtgagaacatgcggtatttggttttctgtttctgtttttgctgagaatgatggtttccagcttcatctatgttcctgcaaaggacatgaactcatccttttttataactgcatagtattccatggtatatatgtgccacattttctttatccagtctatcattaatgggcatttgggttagttccaagtctttgaaaagcattcctatttctccacatcctctccagcatctgttgtttcctgacgttctaatgatcgccattccaactggcataagaggttatcccattgtggtttttatttgcatttctctaatgactactgatgatgagcttttttcatatgtttgttggctacataaatgtcccacgatgcataatcattggattccccagggttgaaatgaaggaaaaaatgttaagggcagccagagagaaaggttgggttactcacaaagggaagcccatcagactaccagtggatctctctgcagaaaccctacaagccagaagagagtgggggccaatattcaacattcttaaggaaaagaattctcaacccagaatttcatgtccagccaaattaagcttcataagcgaaagagaaataaaatcctttacacgcaagcaaatactgagagattttgtcaccaccaggcctgccttacaagaactcctgaaggacacactaaatatggaaaggaaaaaccgataacagccacctcaaaaacataccaaattgtaaagaccatggacactatgaagaaaccacatcaactaacgggcaaaattaacctgctagcatcataatgacaggatcaaattcatacataacagtattagccttaaatgtaaatgggctaaatgccccaattaaaaggcacagactggcaaattggataaagagttaagacccatcagtgtgctgtattcaggagacccatctcacgtgcagacacacataggctcaaaataaagggatggagaaagatttacccagcaaatggaaagcgaaaaaaaagcaggggttgcaatcctagtctctgatgaaacagactttaaaccaacacagacagaaaaagaccaagaagggcattaaataatggtaaagagatcaatgcatcaagaacagctaactatcctaaatatatatgcacccaatacaggagcacccagattcataaagcaagtttttagagacctacaaggagactcagactcccacaaaataatagtgggagattttaacaccccactgtcaatattagacagatcaagacagaaaattaacaaggatattcaggacttgaactcagctctggaccaagtggacctaatagacatctacagaactctccaccccaaatcaacagaatatacattcttctcagcaccacatcgcacttgttctaaaattgaccacataattggaagtaaaacactcctcagcaaatgtaaaagaatggaaatcataaacagtctctcagaccacagtgcaatcaaattagaactcaggattaggaaactcactcaaaactgcacaatgacatggaaactgaacaacttgctcctgaatgactactgggtaaataacgaaattaaggcacaatgacatggaaacggaacaacctgctcctgaatgactaccaggtaaataatgaaattaaggcagaaataaatagacacaatgtaccagaatctctgggacacagctaaagcagtgtttagagggaaatttatagcactaaaatgcccacaggagaaagcaggaaagatctaaaatcgacaccctaacgtcacaattaaaagaactagagaagcaagagcaaacaaattcaaaagctagcagaagacaagaaataactaagatcagagcagaactgaaggagatagagacacagaaaacccttcaaaaaaatcaatgaatccaggagctggttttttgaaaagattaacaaaatagaccactagctagactaataaagaaaagagagaagaatcaaatagacacaataaaaaatgataaaggggaaatcaccactgatcccacagaaatacaaactactatcagagaatactataaaatttttggcattaaaataatctttccactttgctgaatctgccattttttggggtcccgttttgaggcttcctacaatgtaggagtgcactgatttcctgacatgcctaacattttgttatctccaaaatagcaactacacctttttggctttggaattacattccttaggaatccttgttggccctaattatcaggaaaggtcaacatatctactaggtgagggctttcttaacatgagtggaaagtgggagtaattgagcctatataaccatgcacctggtatactttgttacttccagattgtattgaaaatgtgcaatgttttacacccaccagctaaacatcccaacacaataatgtatactctgctgtttataagttacaaaatgccgtactgtataatcatggaaagattattaatattttactattatctatttaaattatatttaatttcgggtagtaaatggctatatttacctaatttgtaagattatactatgcagtttgcatattctcattctcagtgataattgaaacttgctttagagctcgcccatggatctcatgtttacaaaagaggaattttatgctagggaaaatgttatctttatattatatgtacaaatgggtaataaaaaataatagtgtatgtaaattttagaaaattcactagttcagtgagagaacattagaaatattcatttaggtcccgcatatcattttaaaagcatatagaattaatacttattaagcaaacctggaagccatgcctgaggttgaatcctggcttctcttccttatctccaatacgaccttggttgggtaagttacttaacctctctgtgccagtttcctcattgataaaataggaatgatggtacctacctcataaggtttctgtgaggattaaatgaactaatatatgtagacttcttagaatagtttctgatacataagtgctcaataaatgttaactattataatttcatatatatcactaaaaacaatatgttatctcagagagtttcacttaatctaagtgtcattattcaatatcaaagcaggaaaatgtcatctgatatcctcccacttatgaaagttttaatcatccctcatcagaactaaacttctttctcattctggttatgctattaaactttcttcagatattgatgtaaaattctaaccatgcccaactttttttttattatactaattatactgtctttagatgcctacagccatttaactgccatggacttagaaaagccaaactcctgggttatatctgtgaaattacagagtcctatagataaacccaactgtttttggaaaaatatcaattgttttcttcctcatagacaataatctcgtaaaagatttctaatcatgggacagttaatcacggggacagtttctggttgtttcctcagagttatgttggctcattacagaacagacactccttacctgcagaatttgtacattgtggggagtaatttatcccaaaccagttcagacactaggactaaaatgttaatagtaccatttggagaatgctcagtacttgctaaacactttatattaatatttcctttaacctcatcatagcatccctattaggtagattattattcagattttacacacagtgcatttgtacatagagcttgcccaacaccacacaggtagtagtctgatctcaaattaagccctagaagccacagtgggagagtaccagaaggcaggccgttggggatctagccccaggatcctcacctcaatcgtggtagctctactttatttgtttttcatattaggttttctgattttgaatcattagagagttctgctgttaaaaaaaaaaaaaaagggggtggaggtagtgttattgaaaagcacttgcaaaattcagctctgtacatttgagatataactacaacaaaaatgtttctattatgcttttgcccctagataaagagaatccataattgacactatggaattttgcagtttgtcagtaaaatatctgatacttattttaatagatctgtatgtttcttattaactgagtatcagccatattggttgatgtgaacagaatgtgagaataaagttttgtttaggatttctcaatgttaaattcttacagttgaaatgatagattgatgcttattcataaaaaatattttgatatagattgtttattttaaaaaaactcaagataattttaacagcaaagctcagtggtggttctttcaccagttaaaaatgtacttttctttttaaaatatgcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaagtaagaatatagggacattataatttatttaatgttataggttgagtattccaagtctgaaaatctgaaatatgaaatgctccaaaatccaaaattttttgagtgccagcatggtgctcaaaggaaatattcattgggacacttggatttcagatttttcaattaggggtgctaaatataatgcaaatattccaaaatcagaaacccctctggtctcaagcattttgaatagggatattcaacctttaataactgcatatatccatttaacttagatttggaactttgtttctcagatacagattcagcagtcattacattgagtaaccactatctaaatgttcagattcaacagtcatgttttgagtaacttctatatgccgggtactgggtgaatactgtcatacaacaagcattcttattcttatttaattaaagtaacatctcttgaggtgttgtcctccagccagtactcttcacagtacctgtgcatgcacgatagggccatcaccacatctgaacatatgtgaggtggatcctcatggcaagtcctccttcatgtcactccttttcacacatctcacccccaatcccactaggcagctgaggagcacaacttccatagcagcctactaatctgctgttcacatagacttgagaagtagatcaaaacagtgggggggaggggggaaggaaaacatacattccctggctgtagagggagagccaattttgtggcattatgaatttgagttaccaaactgtaatgacatactttcctgtataagacaattagtataaatggaaaatgaaatgaaaattatcactttgtaattgtgaatgaaatcagttatttgctcattttaaagtagaatttaaattatacctacataagtattgttttgattttcaagcatgcaataaatcagaccagacaggaaaactacaaagaacctcccactgcaacacacacatgccttgtatttaggattagcatggcaaatcctattaaaatgtatttaaaattctttttttaaaaaaatggcattagcatctgaaggttgactgacttctaaaaattatactcccccatctctactaaaaatacaaaaatatgctggaaatggtggcaggcgcctgtagtcccagctactagggaggctgaggcaggagaatggagtgaacccatgaggcggaggttccagtgagctgagatcgtgccactgcactccagcctgggcgacagagcaagactccgtctcaaaaaaaaaaaaattgtactcatcaaaatgttggtaattgtgtttaattcaatacataagaatgcccttaaaggttggtttttaactttgggttattttcatttgaaatttcagcacgcttcttccctctccaccatacccagccagttttccctaaacctcttctctattttgtttttatccgtaacaataccatctaacatattcctgttttgcttctttctgttttcctagctctttccactagaatctgaacaccataacgcagggattatttttatagtactatttcattatattatttttattatactattattttatagtactgtttacttttatactcccagtgcttagatacctagaataggcacttaatatttgttgaatgattaaatcatattgctatgattagaatatatttattttaaatttcacagaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatatgaacacagcacagatttgttagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactggaatacttatttttcatataaaaatctaaatgtgttaataaatcatttcatacaaaagtacattattaaataaccacattattaaaataattgcaagaaaatggaccatatttacaatgttttgtaaacttgctagtgtgtggatatgtaccctacttgtgaaatacatttgaagatataaagagcagccaaaatgatggcaaaatggtaggctaatattttctattattattggagaacatatcatattttggaatcatgcaattttgcacacagtgaaaccattaattttccaaggtaattcctttagaatatggtattggcatgcagtttcttacttatctagaatatttggcttatctgaaagatatcaatttaagatctctggaagtgttagaatttttgatccttcacagtgtcaatatttaatgaatcactaagctttatttattagacgtgttgagtgagtgctgagttccttgctgccacttttgttaccattgtcacacactatgtgtaaaccagtcccaccacttattactaataaaattttgactgataatttatatttgcacttacaatatatatatcctgtccttatatttctctagagtacattttccatcatgtttaagtgtatttctgctattatttcctctcctgcagaatacatacaagtgtatgtgtataaagtcatacatgtacaagcatgcatattgagattgaatcacatttccatactgtctgttattttattgggttttatattgggtttctttagtttatgttgttttctcaaaagcagcattttaaattacgaatactggacttattggatttaattataaatccaattactactggaaactcatttttacataatatagtccttaaattatttaacccttgctaagtaattgacatatgtaacaataactagcctaaagaaacccaaaaaagtatctctcccgagctgaaacttaaaaattcgtaagtgtaagaaagaatgtgagaatatattaaatgcacactgtaccattagatgaaatcttacttgagaaattgccataagccatattacagatcttactttgttactgaatcagattaatttcttgttataataattttcatcataaattttctatttttaaagccgctggtactagaaatattcttttaatgctatatctatgtacctactgacacatttttctccataaaagtacttttaaaaatta

SEQ ID NO: 2 - RNA, 5995 nt, homo sapien
agucccgagaggugcccgagggaaaaggaggcggcagcuaaacugguccuggagagaagccccuuccgccccucuccucagccagcaugucccggacuccgccgcuccucaguccgcgcgguggggaccccgggccguggcggccggcgcagcccugacggguugcgaaccagggggcgccccgaacgcggggguuggggucugggagcgcgagcggccgcuacgguacgagcggggugugcugagucccguggccacccccggccccagccaugaggagggacgagcgagacgccaaagccaugcggucccugcagccgccggauggggccggcucgccccccgagagucugaggaacggcuacgugaagagcugcgugagccccuugcggcaggacccuccgcgcggcuucuucuuccaccucugccgcuucugcaacguggagcugcggccgccgccggccucuccccagcagccgcggcgcugcucccccuucugccgggcgcgccucucgcugggcgcccuggcugccuuuguccucgcccugcugcugggcgcggaacccgagagcugggcugccggggccgccuggcugcggacgcugcugagcguguguucgcacagcuugagcccccucuucagcaucgccugugccuucuucuuccucaccugcuuccucacccggaccaagcggggacccggcccgggccggagcugcggcuccugguggcugcuggcgcugcccgccugcuguuaccugggggacuucuugguguggcagugguggucuuggccuuggggggauggcgacgcaggguccgcggccccgcacacgcccccggaggcggcagcgggcagguugcugcuggugcugagcugcguagggcugcugcugacgcucgcgcacccgcugcggcuccggcacugcguucuggugcugcuccuggccagcuucgucuggugggucuccuucaccagccucgggucgcugcccuccgcccucaggccgcugcucuccggccugguggggggcgcuggcugccugcuggcccugggguuggaucacuucuuucaaaucagggaagcgccucuucauccucgacuguccagugccgccgaagaaaaagugccugugauccgaccccggaggagguccagcugcgugucguuaggagaaacugcagccaguuacuauggcaguugcaaaauauucaggagaccgucguugccuuguauuuccagagaacagaugauucuuugggauugggacuuaaaacaaugguauaagccucauuaucaaaauucuggagguggaaauggaguugaucuuucagugcuaaaugaggcucgcaauauggugucagaucuucugacugauccaagccuuccaccacaagucauuuccucucuacggaguauuaguagcuuaaugggugcuuucucagguuccuguaggccaaagauuaauccucucacaccauuuccuggauuuuaccccuguucugaaauagaggacccagcugagaaaggggauagaaaacuuaacaagggacuaaauaggaauaguuugccaacuccacagcugaggagaagcucaggaacuucaggauugcuaccuguugaacagucuucaaggugggaucguaauaauggcaaaagaccucaccaagaauuuggcauuucaagucaaggaugcuaucuaaaugggccuuuuaauucaaaucuacugacuaucccgaagcaaaggucaucuucuguaucacugacucaccauguaggucucagaagagcugguguuuuguccagucugaguccugugaauucuuccaaccauggaccagugucuacuggcucucuaacuaaucgaucacccauagaauuuccugauacugcugauuuucuuaauaagccaagcguuaucuugcagagaucucugggcaaugcaccuaauacuccagauuuuuaucagcaacuuagaaauucugauagcaaucuguguaacagcuguggacaucaaaugcugaaauauguuucaacaucugaaucagaugguacagauugcugcaguggaaaaucaggugaagaagaaaacauuuucucgaaagaaucauucaaacuuauggaaacucaacaagaagaggaaacagagaagaaagacagcagaaaauuauuucaggaaggugauaaguggcuaacagaagaggcacagagugaacagcaaacaaauauugaacaggaaguaucacuggaccugauuuuaguagaagaguaugacucauuaauagaaaagaugagcaacuggaauuuuccaauuuuugaacuuguagaaaagaugggagagaaaucaggaaggauucucagucagguuauguauaccuuauuucaagacacugguuuauuggaaauauuuaaaauucccacucaacaauuuaugaacuauuuucgugcauuagaaaauggcuaucgagacauuccuuaucacaaucguauacaugccacagaugugcuacaugcaguuugguaucugacaacacggccaguuccuggcuuacagcagauccacaaugguuguggaacaggaaaugaaacagauucugaugguagaauuaaccaugggcgaauugcuuauauuucuucgaagagcugcucuaauccugaugagaguuauggcugccugucuucaaacauuccugcauuagaauugauggcucuauacguggcagcugccaugcaugauuaugaucacccagggaggacaaaugcauuucuaguggcuacaaaugccccucaggcaguuuuauacaaugacagaucuguucuggaaaaucaucaugcugcgucagcuuggaaucuauaucuuucucgcccagaauacaacuuccuucuucaucuugaucauguggaauucaagcgcuuucguuuuuuagucauugaagcaauccuugcuacggaucuuaaaaagcauuuugauuuucucgcagaauucaaugccaaggcaaaugauguaaauaguaauggcauagaauggaguaaugaaaaugaucgccucuugguaugccaggugugcaucaaacuggcagauauaaauggcccagcaaaaguucgagacuugcauuugaaauggacagaaggcauugucaaugaauuuuaugagcagggagaugaagaagcaaaucuuggucugcccaucaguccauucauggaucguucuucuccucaacuagcaaaacuccaagaaucuuuuaucacccacauaguggguccccuguguaacuccuaugaugcugcugguuugcuaccaggucagugguuagaagcagaagaggauaaugauacugaaaguggugaugaugaagacggugaagaauuagauacagaagaugaagaaauggaaaacaaucuaaauccaaaaccaccaagaaggaaaagcagacggcgaauauuuugucagcuaaugcaccaccucacugaaaaccacaagauauggaaggaaaucguagaggaagaagaaaaauguaaagcugaugggaauaaacugcagguggagaauuccuccuuaccucaagcagaugagauucagguaauugaagaggcagaugaagaggaauagcgacaguuugaguaaaagaaaagucauauugaagaagcccagaggguugugcccaggggcagaaaucauugccuaguguucaccggcugacucucaacugaccauucccauguggacaggccuuaauacugugagaggauccuugcucugcuggcaguuucccacuccuaugcacuuucacaggaacuagaaaacuauucuuaaaccaaaaauaccauccguguugacccauguugcagagcccuuacuuaaauccuucacugguguaugaauacuuugucauaaugcugcuuugcuggguagugagcucuuauuuuucacugggggucagcuauaacuaaaaacucaagugacauauuucaguuaccaaaguggccaggaacuuuuugcuuuuaugaaaauagauucauauuguauuucccagugugucuuuuaugucuuugaauguuuuggagaaaagucuaugccugucuaaaaaugaauccaguguugccuuucugagggauuucugcucaaugcaauacacuguucagugcuauucucccagcuagguuuauccaugaaggacugagugaccuuuguuguauuuaacaaaauccaggugcaucaauuucugaugcuuuuuacuauuguguauuaucuacuauguguguuuuauuucugcugagaguauucagguuugccauggacaucagaaguuugaauuccagucuuaucuuauguuccauggcugaauuuuaaagcuguuuagguuuaacaaugaagggauuuauucuuuagucaaaauuguuguuuuuacucuagcucaggauucguauuuuuaaagauuuaguuaauaugaacacagcacagauuuguuagaagaaaaaaaauuugcuguaauaccaaaacuaaccucaucaaagauacagaaaaaaagaaauauagugagcccuaaaggacacauacauugaauaaauaauuggaacaugugguuaucuuuagauccacaucuuagcugucauuuguucacucuaaaacugauguucaucuuucuguuaauuucccucugccuaaagacuacaugacagaaaugaccuaucacuacuuauuauuucugaagccuaacugcaagacugauuucugagaacaaguaaagaacuggaauacuuauuuuucauauaaaaaucuaaauguguuaauaaaucauuucauacaaaaguacauuauuaaauaaccacauuauuaaaauaauugcaagaaaauggaccauauuuacaauguuuuguaaacuugcuaguguguggauauguacccuacuugugaaauacauuugaagauauaaagagcagccaaaaugauggcaaaaugguaggcuaauauuuucuauuauuauuggagaacauaucauauuuuggaaucaugcaauuuugcacacagugaaaccauuaauuuuccaagguaauuccuuuagaauaugguauuggcaugcaguuucuuacuuaucuagaauauuuggcuuaucugaaagauaucaauuuaagaucucuggaaguguuagaauuuuugauccuucacagugucaauauuuaaugaaucacuaagcuuuauuuauuagacguguugagugagugcugaguuccuugcugccacuuuuguuaccauugucacacacuauguguaaaccagucccaccacuuauuacuaauaaaauuuugacugauaauuuauauuugcacuuacaauauauauauccuguccuuauauuucucuagaguacauuuuccaucauguuuaaguguauuucugcuauuauuuccucuccugcagaauacauacaaguguauguguauaaagucauacauguacaagcaugcauauugagauugaaucacauuuccauacugucuguuauuuuauuggguuuuauauuggguuucuuuaguuuauguuguuuucucaaaagcagcauuuuaaauuacgaauacuggacuuauuggauuuaauuauaaauccaauuacuacuggaaacucauuuuuacauaauauaguccuuaaauuauuuaacccuugcuaaguaauugacauauguaacaauaacuagccuaaagaaacccaaaaaaguaucucucccgagcugaaacuuaaaaauucguaaguguaagaaagaaugugagaauauauuaaaugcacacuguaccauuagaugaaaucuuacuugagaaauugccauaagccauauuacagaucuuacuuuguuacugaaucagauuaauuucuuguuauaauaauuuucaucauaaauuuucuauuuuuaaagccgcugguacuagaaauauucuuuuaaugcuauaucuauguaccuacugacacauuuuucuccauaaaaguacuuuuaaaaauua

SEQ ID NO: 3 - RNA, 3665 nt, homo sapien
gaggcggcagcuaaacugguccuggagagaagccccuuccgccccucuccucagccagcaugucccggacuccgccgcuccucaguccgcgcgguggggaccccgggccguggcggccggcgcagcccugacggguugcgaaccagggggcgccccgaacgcggggguuggggucugggagcgcgagcggccgcuacgguacgagcggggugugcugagucccguggccacccccggccccagccaugaggagggacgagcgagacgccaaagccaugcggucccugcagccgccggauggggccggcucgccccccgagagucugaggaacggcuacgugaagagcugcgugagccccuugcggcaggacccuccgcgcggcuucuucuuccaccucugccgcuucugcaacguggagcugcggccgccgccggccucuccccagcagccgcggcgcugcucccccuucugccgggcgcgccucucgcugggcgcccuggcugccuuuguccucgcccugcugcugggcgcggaacccgagagcugggcugccggggccgccuggcugcggacgcugcugagcguguguucgcacagcuugagcccccucuucagcaucgccugugccuucuucuuccucaccugcuuccucacccggaccaagcggggacccggcccgggccggagcugcggcuccugguggcugcuggcgcugcccgccugcuguuaccugggggacuucuugguguggcagugguggucuuggccuuggggggauggcgacgcaggguccgcggccccgcacacgcccccggaggcggcagcgggcagguugcugcuggugcugagcugcguagggcugcugcugacgcucgcgcacccgcugcggcuccggcacugcguucuggugcugcuccuggccagcuucgucuggugggucuccuucaccagccucgggucgcugcccuccgcccucaggccgcugcucuccggccugguggggggcgcuggcugccugcuggcccugggguuggaucacuucuuucaaaucagggaagcgccucuucauccucgacuguccagugccgccgaagaaaaagugccugugauccgaccccggaggagguccagcugcgugucguuaggagaaacugcagccaguuacuauggcaguugcaaaauauucaggagaccgucguugccuuguauuuccagagaacagaugauucuuugggauugggacuuaaaacaaugguauaagccucauuaucaaaauucuggagguggaaauggaguugaucuuucagugcuaaaugaggcucgcaauauggugucagaucuucugacugauccaagccuuccaccacaaggacuaaauaggaauaguuugccaacuccacagcugaggagaagcucaggaacuucaggauugcuaccuguugaacagucuucaaggugggaucguaauaauggcaaaagaccucaccaagaauuuggcauuucaagucaaggaugcuaucuaaaugggccuuuuaauucaaaucuacugacuaucccgaagcaaaggucaucuucuguaucacugacucaccauguaggucucagaagagcugguguuuuguccagucugaguccugugaauucuuccaaccauggaccagugucuacuggcucucuaacuaaucgaucacccauagaauuuccugauacugcugauuuucuuaauaagccaagcguuaucuugcagagaucucugggcaaugcaccuaauacuccagauuuuuaucagcaacuuagaaauucugauagcaaucuguguaacagcuguggacaucaaaugcugaaauauguuucaacaucugaaucagaugguacagauugcugcaguggaaaaucaggugaagaagaaaacauuuucucgaaagaaucauucaaacuuauggaaacucaacaagaagaggaaacagagaagaaagacagcagaaaauuauuucaggaaggugauaaguggcuaacagaagaggcacagagugaacagcaaacaaauauugaacaggaaguaucacuggaccugauuuuaguagaagaguaugacucauuaauagaaaagaugagcaacuggaauuuuccaauuuuugaacuuguagaaaagaugggagagaaaucaggaaggauucucagucagguuauguauaccuuauuucaagacacugguuuauuggaaauauuuaaaauucccacucaacaauuuaugaacuauuuucgugcauuagaaaauggcuaucgagacauuccuuaucacaaucguauacaugccacagaugugcuacaugcaguuugguaucugacaacacggccaguuccuggcuuacagcagauccacaaugguuguggaacaggaaaugaaacagauucugaugguagaauuaaccaugggcgaauugcuuauauuucuucgaagagcugcucuaauccugaugagaguuauggcugccugucuucaaacauuccugcauuagaauugauggcucuauacguggcagcugccaugcaugauuaugaucacccagggaggacaaaugcauuucuaguggcuacaaaugccccucaggcaguuuuauacaaugacagaucuguucuggaaaaucaucaugcugcgucagcuuggaaucuauaucuuucucgcccagaauacaacuuccuucuucaucuugaucauguggaauucaagcgcuuucguuuuuuagucauugaagcaauccuugcuacggaucuuaaaaagcauuuugauuuucucgcagaauucaaugccaaggcaaaugauguaaauaguaauggcauagaauggaguaaugaaaaugaucgccucuugguaugccaggugugcaucaaacuggcagauauaaauggcccagcaaaaguucgagacuugcauuugaaauggacagaaggcauugucaaugaauuuuaugagcagggagaugaagaagcaaaucuuggucugcccaucaguccauucauggaucguucuucuccucaacuagcaaaacuccaagaaucuuuuaucacccacauaguggguccccuguguaacuccuaugaugcugcugguuugcuaccaggucagugguuagaagcagaagaggauaaugauacugaaaguggugaugaugaagacggugaagaauuagauacagaagaugaagaaauggaaaacaaucuaaauccaaaaccaccaagaaggaaaagcagacggcgaauauuuugucagcuaaugcaccaccucacugaaaaccacaagauauggaaggaaaucguagaggaagaagaaaaauguaaagcugaugggaauaaacugcagguggagaauuccuccuuaccucaagcagaugagauucagguaauugaagaggcagaugaagaggaauagcgacaguuugaguaaaagaaaagucauauugaagaagcccagaggguugugcccaggggcagaaaucauugccuaguguucaccggcugacucucaacugaccauucccauguggacaggccuuaauacugugagaggauccuugcucugcuggcaguuucccacuccuaugcacuuucacaggaacuagaaaacuauucuuaaaccaaaaauaccauccguguugacccaugu

SEQ ID NO: 4 - RNA, 5842 nt, homo sapien
agucccgagaggugcccgagggaaaaggaggcggcagcuaaacugguccuggagagaagccccuuccgccccucuccucagccagcaugucccggacuccgccgcuccucaguccgcgcgguggggaccccgggccguggcggccggcgcagcccugacggguugcgaaccagggggcgccccgaacgcggggguuggggucugggagcgcgagcggccgcuacgguacgagcggggugugcugagucccguggccacccccggccccagccaugaggagggacgagcgagacgccaaagccaugcggucccugcagccgccggauggggccggcucgccccccgagagucugaggaacggcuacgugaagagcugcgugagccccuugcggcaggacccuccgcgcggcuucuucuuccaccucugccgcuucugcaacguggagcugcggccgccgccggccucuccccagcagccgcggcgcugcucccccuucugccgggcgcgccucucgcugggcgcccuggcugccuuuguccucgcccugcugcugggcgcggaacccgagagcugggcugccggggccgccuggcugcggacgcugcugagcguguguucgcacagcuugagcccccucuucagcaucgccugugccuucuucuuccucaccugcuuccucacccggaccaagcggggacccggcccgggccggagcugcggcuccugguggcugcuggcgcugcccgccugcuguuaccugggggacuucuugguguggcagugguggucuuggccuuggggggauggcgacgcaggguccgcggccccgcacacgcccccggaggcggcagcgggcagguugcugcuggugcugagcugcguagggcugcugcugacgcucgcgcacccgcugcggcuccggcacugcguucuggugcugcuccuggccagcuucgucuggugggucuccuucaccagccucgggucgcugcccuccgcccucaggccgcugcucuccggccugguggggggcgcuggcugccugcuggcccugggguuggaucacuucuuucaaaucagggaagcgccucuucauccucgacuguccagugccgccgaagaaaaagugccugugauccgaccccggaggagguccagcugcgugucguuaggagaaacugcagccaguuacuauggcaguugcaaaauauucaggagaccgucguugccuuguauuuccagagaacagaugauucuuugggauugggacuuaaaacaaugguauaagccucauuaucaaaauucuggagguggaaauggaguugaucuuucagugcuaaaugaggcucgcaauauggugucagaucuucugacugauccaagccuuccaccacaaggacuaaauaggaauaguuugccaacuccacagcugaggagaagcucaggaacuucaggauugcuaccuguugaacagucuucaaggugggaucguaauaauggcaaaagaccucaccaagaauuuggcauuucaagucaaggaugcuaucuaaaugggccuuuuaauucaaaucuacugacuaucccgaagcaaaggucaucuucuguaucacugacucaccauguaggucucagaagagcugguguuuuguccagucugaguccugugaauucuuccaaccauggaccagugucuacuggcucucuaacuaaucgaucacccauagaauuuccugauacugcugauuuucuuaauaagccaagcguuaucuugcagagaucucugggcaaugcaccuaauacuccagauuuuuaucagcaacuuagaaauucugauagcaaucuguguaacagcuguggacaucaaaugcugaaauauguuucaacaucugaaucagaugguacagauugcugcaguggaaaaucaggugaagaagaaaacauuuucucgaaagaaucauucaaacuuauggaaacucaacaagaagaggaaacagagaagaaagacagcagaaaauuauuucaggaaggugauaaguggcuaacagaagaggcacagagugaacagcaaacaaauauugaacaggaaguaucacuggaccugauuuuaguagaagaguaugacucauuaauagaaaagaugagcaacuggaauuuuccaauuuuugaacuuguagaaaagaugggagagaaaucaggaaggauucucagucagguuauguauaccuuauuucaagacacugguuuauuggaaauauuuaaaauucccacucaacaauuuaugaacuauuuucgugcauuagaaaauggcuaucgagacauuccuuaucacaaucguauacaugccacagaugugcuacaugcaguuugguaucugacaacacggccaguuccuggcuuacagcagauccacaaugguuguggaacaggaaaugaaacagauucugaugguagaauuaaccaugggcgaauugcuuauauuucuucgaagagcugcucuaauccugaugagaguuauggcugccugucuucaaacauuccugcauuagaauugauggcucuauacguggcagcugccaugcaugauuaugaucacccagggaggacaaaugcauuucuaguggcuacaaaugccccucaggcaguuuuauacaaugacagaucuguucuggaaaaucaucaugcugcgucagcuuggaaucuauaucuuucucgcccagaauacaacuuccuucuucaucuugaucauguggaauucaagcgcuuucguuuuuuagucauugaagcaauccuugcuacggaucuuaaaaagcauuuugauuuucucgcagaauucaaugccaaggcaaaugauguaaauaguaauggcauagaauggaguaaugaaaaugaucgccucuugguaugccaggugugcaucaaacuggcagauauaaauggcccagcaaaaguucgagacuugcauuugaaauggacagaaggcauugucaaugaauuuuaugagcagggagaugaagaagcaaaucuuggucugcccaucaguccauucauggaucguucuucuccucaacuagcaaaacuccaagaaucuuuuaucacccacauaguggguccccuguguaacuccuaugaugcugcugguuugcuaccaggucagugguuagaagcagaagaggauaaugauacugaaaguggugaugaugaagacggugaagaauuagauacagaagaugaagaaauggaaaacaaucuaaauccaaaaccaccaagaaggaaaagcagacggcgaauauuuugucagcuaaugcaccaccucacugaaaaccacaagauauggaaggaaaucguagaggaagaagaaaaauguaaagcugaugggaauaaacugcagguggagaauuccuccuuaccucaagcagaugagauucagguaauugaagaggcagaugaagaggaauagcgacaguuugaguaaaagaaaagucauauugaagaagcccagaggguugugcccaggggcagaaaucauugccuaguguucaccggcugacucucaacugaccauucccauguggacaggccuuaauacugugagaggauccuugcucugcuggcaguuucccacuccuaugcacuuucacaggaacuagaaaacuauucuuaaaccaaaaauaccauccguguugacccauguugcagagcccuuacuuaaauccuucacugguguaugaauacuuugucauaaugcugcuuugcuggguagugagcucuuauuuuucacugggggucagcuauaacuaaaaacucaagugacauauuucaguuaccaaaguggccaggaacuuuuugcuuuuaugaaaauagauucauauuguauuucccagugugucuuuuaugucuuugaauguuuuggagaaaagucuaugccugucuaaaaaugaauccaguguugccuuucugagggauuucugcucaaugcaauacacuguucagugcuauucucccagcuagguuuauccaugaaggacugagugaccuuuguuguauuuaacaaaauccaggugcaucaauuucugaugcuuuuuacuauuguguauuaucuacuauguguguuuuauuucugcugagaguauucagguuugccauggacaucagaaguuugaauuccagucuuaucuuauguuccauggcugaauuuuaaagcuguuuagguuuaacaaugaagggauuuauucuuuagucaaaauuguuguuuuuacucuagcucaggauucguauuuuuaaagauuuaguuaauaugaacacagcacagauuuguuagaagaaaaaaaauuugcuguaauaccaaaacuaaccucaucaaagauacagaaaaaaagaaauauagugagcccuaaaggacacauacauugaauaaauaauuggaacaugugguuaucuuuagauccacaucuuagcugucauuuguucacucuaaaacugauguucaucuuucuguuaauuucccucugccuaaagacuacaugacagaaaugaccuaucacuacuuauuauuucugaagccuaacugcaagacugauuucugagaacaaguaaagaacuggaauacuuauuuuucauauaaaaaucuaaauguguuaauaaaucauuucauacaaaaguacauuauuaaauaaccacauuauuaaaauaauugcaagaaaauggaccauauuuacaauguuuuguaaacuugcuaguguguggauauguacccuacuugugaaauacauuugaagauauaaagagcagccaaaaugauggcaaaaugguaggcuaauauuuucuauuauuauuggagaacauaucauauuuuggaaucaugcaauuuugcacacagugaaaccauuaauuuuccaagguaauuccuuuagaauaugguauuggcaugcaguuucuuacuuaucuagaauauuuggcuuaucugaaagauaucaauuuaagaucucuggaaguguuagaauuuuugauccuucacagugucaauauuuaaugaaucacuaagcuuuauuuauuagacguguugagugagugcugaguuccuugcugccacuuuuguuaccauugucacacacuauguguaaaccagucccaccacuuauuacuaauaaaauuuugacugauaauuuauauuugcacuuacaauauauauauccuguccuuauauuucucuagaguacauuuuccaucauguuuaaguguauuucugcuauuauuuccucuccugcagaauacauacaaguguauguguauaaagucauacauguacaagcaugcauauugagauugaaucacauuuccauacugucuguuauuuuauuggguuuuauauuggguuucuuuaguuuauguuguuuucucaaaagcagcauuuuaaauuacgaauacuggacuuauuggauuuaauuauaaauccaauuacuacuggaaacucauuuuuacauaauauaguccuuaaauuauuuaacccuugcuaaguaauugacauauguaacaauaacuagccuaaagaaacccaaaaaaguaucucucccgagcugaaacuuaaaaauucguaaguguaagaaagaaugugagaauauauuaaaugcacacuguaccauuagaugaaaucuuacuugagaaauugccauaagccauauuacagaucuuacuuuguuacugaaucagauuaauuucuuguuauaauaauuuucaucauaaauuuucuauuuuuaaagccgcugguacuagaaauauucuuuuaaugcuauaucuauguaccuacugacacauuuuucuccauaaaaguacuuuuaaaaauua

SEQ ID NO: 5 - RNA, 6229 nt, homo sapien
agucccgagaggugcccgagggaaaaggaggcggcagcuaaacugguccuggagagaagccccuuccgccccucuccucagccagcaugucccggacuccgccgcuccucaguccgcgcgguggggaccccgggccguggcggccggcgcagcccugacggguugcgaaccagggggcgccccgaacgcggggguuggggucugggagcgcgagcggccgcuacgguacgagcggggugugcugagucccguggccacccccggccccagccaugaggagggacgagcgagacgccaaagccaugcggucccugcagccgccggauggggccggcucgccccccgagagucugaggaacggcuacgugaagagcugcgugagccccuugcggcaggacccuccgcgcggcuucuucuuccaccucugccgcuucugcaacguggagcugcggccgccgccggccucuccccagcagccgcggcgcugcucccccuucugccgggcgcgccucucgcugggcgcccuggcugccuuuguccucgcccugcugcugggcgcggaacccgagagcugggcugccggggccgccuggcugcggacgcugcugagcguguguucgcacagcuugagcccccucuucagcaucgccugugccuucuucuuccucaccugcuuccucacccggaccaagcggggacccggcccgggccggagcugcggcuccugguggcugcuggcgcugcccgccugcuguuaccugggggacuucuugguguggcagugguggucuuggccuuggggggauggcgacgcaggguccgcggccccgcacacgcccccggaggcggcagcgggcagguugcugcuggugcugagcugcguagggcugcugcugacgcucgcgcacccgcugcggcuccggcacugcguucuggugcugcuccuggccagcuucgucuggugggucuccuucaccagccucgggucgcugcccuccgcccucaggccgcugcucuccggccugguggggggcgcuggcugccugcuggcccugggguuggaucacuucuuucaaaucagggaagcgccucuucauccucgacuguccagugccgccgaagaaaaagugccugugauccgaccccggaggagguccagcugcgugucguuaggagaaacugcagccaguuacuauggcaguugcaaaauauucaggagaccgucguugccuuguauuuccagagaacagaugauucuuugggauugggacuuaaaacaaugguauaagccucauuaucaagcuggagugcaguggcaugaucucggcucaccgcaaccuccagcucccugguucaagcgauucuccugccucagccuccggaguagcugggauuacaggcaugugccaccacaccuggcuaauuuuguauuuuuaguagagaugggauuucuccauguuggucaggcuggucuugaacucccgaccucaggugaucugcccaccucggccucccaaagugcugggauuacagggaauucuggagguggaaauggaguugaucuuucagugcuaaaugaggcucgcaauauggugucagaucuucugacugauccaagccuuccaccacaagucauuuccucucuacggaguauuaguagcuuaaugggugcuuucucagguuccuguaggccaaagauuaauccucucacaccauuuccuggauuuuaccccuguucugaaauagaggacccagcugagaaaggggauagaaaacuuaacaagggacuaaauaggaauaguuugccaacuccacagcugaggagaagcucaggaacuucaggauugcuaccuguugaacagucuucaaggugggaucguaauaauggcaaaagaccucaccaagaauuuggcauuucaagucaaggaugcuaucuaaaugggccuuuuaauucaaaucuacugacuaucccgaagcaaaggucaucuucuguaucacugacucaccauguaggucucagaagagcugguguuuuguccagucugaguccugugaauucuuccaaccauggaccagugucuacuggcucucuaacuaaucgaucacccauagaauuuccugauacugcugauuuucuuaauaagccaagcguuaucuugcagagaucucugggcaaugcaccuaauacuccagauuuuuaucagcaacuuagaaauucugauagcaaucuguguaacagcuguggacaucaaaugcugaaauauguuucaacaucugaaucagaugguacagauugcugcaguggaaaaucaggugaagaagaaaacauuuucucgaaagaaucauucaaacuuauggaaacucaacaagaagaggaaacagagaagaaagacagcagaaaauuauuucaggaaggugauaaguggcuaacagaagaggcacagagugaacagcaaacaaauauugaacaggaaguaucacuggaccugauuuuaguagaagaguaugacucauuaauagaaaagaugagcaacuggaauuuuccaauuuuugaacuuguagaaaagaugggagagaaaucaggaaggauucucagucagguuauguauaccuuauuucaagacacugguuuauuggaaauauuuaaaauucccacucaacaauuuaugaacuauuuucgugcauuagaaaauggcuaucgagacauuccuuaucacaaucguauacaugccacagaugugcuacaugcaguuugguaucugacaacacggccaguuccuggcuuacagcagauccacaaugguuguggaacaggaaaugaaacagauucugaugguagaauuaaccaugggcgaauugcuuauauuucuucgaagagcugcucuaauccugaugagaguuauggcugccugucuucaaacauuccugcauuagaauugauggcucuauacguggcagcugccaugcaugauuaugaucacccagggaggacaaaugcauuucuaguggcuacaaaugccccucaggcaguuuuauacaaugacagaucuguucuggaaaaucaucaugcugcgucagcuuggaaucuauaucuuucucgcccagaauacaacuuccuucuucaucuugaucauguggaauucaagcgcuuucguuuuuuagucauugaagcaauccuugcuacggaucuuaaaaagcauuuugauuuucucgcagaauucaaugccaaggcaaaugauguaaauaguaauggcauagaauggaguaaugaaaaugaucgccucuugguaugccaggugugcaucaaacuggcagauauaaauggcccagcaaaaguucgagacuugcauuugaaauggacagaaggcauugucaaugaauuuuaugagcagggagaugaagaagcaaaucuuggucugcccaucaguccauucauggaucguucuucuccucaacuagcaaaacuccaagaaucuuuuaucacccacauaguggguccccuguguaacuccuaugaugcugcugguuugcuaccaggucagugguuagaagcagaagaggauaaugauacugaaaguggugaugaugaagacggugaagaauuagauacagaagaugaagaaauggaaaacaaucuaaauccaaaaccaccaagaaggaaaagcagacggcgaauauuuugucagcuaaugcaccaccucacugaaaaccacaagauauggaaggaaaucguagaggaagaagaaaaauguaaagcugaugggaauaaacugcagguggagaauuccuccuuaccucaagcagaugagauucagguaauugaagaggcagaugaagaggaauagcgacaguuugaguaaaagaaaagucauauugaagaagcccagaggguugugcccaggggcagaaaucauugccuaguguucaccggcugacucucaacugaccauucccauguggacaggccuuaauacugugagaggauccuugcucugcuggcaguuucccacuccuaugcacuuucacaggaacuagaaaacuauucuuaaaccaaaaauaccauccguguugacccauguugcagagcccuuacuuaaauccuucacugguguaugaauacuuugucauaaugcugcuuugcuggguagugagcucuuauuuuucacugggggucagcuauaacuaaaaacucaagugacauauuucaguuaccaaaguggccaggaacuuuuugcuuuuaugaaaauagauucauauuguauuucccagugugucuuuuaugucuuugaauguuuuggagaaaagucuaugccugucuaaaaaugaauccaguguugccuuucugagggauuucugcucaaugcaauacacuguucagugcuauucucccagcuagguuuauccaugaaggacugagugaccuuuguuguauuuaacaaaauccaggugcaucaauuucugaugcuuuuuacuauuguguauuaucuacuauguguguuuuauuucugcugagaguauucagguuugccauggacaucagaaguuugaauuccagucuuaucuuauguuccauggcugaauuuuaaagcuguuuagguuuaacaaugaagggauuuauucuuuagucaaaauuguuguuuuuacucuagcucaggauucguauuuuuaaagauuuaguuaauaugaacacagcacagauuuguuagaagaaaaaaaauuugcuguaauaccaaaacuaaccucaucaaagauacagaaaaaaagaaauauagugagcccuaaaggacacauacauugaauaaauaauuggaacaugugguuaucuuuagauccacaucuuagcugucauuuguucacucuaaaacugauguucaucuuucuguuaauuucccucugccuaaagacuacaugacagaaaugaccuaucacuacuuauuauuucugaagccuaacugcaagacugauuucugagaacaaguaaagaacuggaauacuuauuuuucauauaaaaaucuaaauguguuaauaaaucauuucauacaaaaguacauuauuaaauaaccacauuauuaaaauaauugcaagaaaauggaccauauuuacaauguuuuguaaacuugcuaguguguggauauguacccuacuugugaaauacauuugaagauauaaagagcagccaaaaugauggcaaaaugguaggcuaauauuuucuauuauuauuggagaacauaucauauuuuggaaucaugcaauuuugcacacagugaaaccauuaauuuuccaagguaauuccuuuagaauaugguauuggcaugcaguuucuuacuuaucuagaauauuuggcuuaucugaaagauaucaauuuaagaucucuggaaguguuagaauuuuugauccuucacagugucaauauuuaaugaaucacuaagcuuuauuuauuagacguguugagugagugcugaguuccuugcugccacuuuuguuaccauugucacacacuauguguaaaccagucccaccacuuauuacuaauaaaauuuugacugauaauuuauauuugcacuuacaauauauauauccuguccuuauauuucucuagaguacauuuuccaucauguuuaaguguauuucugcuauuauuuccucuccugcagaauacauacaaguguauguguauaaagucauacauguacaagcaugcauauugagauugaaucacauuuccauacugucuguuauuuuauuggguuuuauauuggguuucuuuaguuuauguuguuuucucaaaagcagcauuuuaaauuacgaauacuggacuuauuggauuuaauuauaaauccaauuacuacuggaaacucauuuuuacauaauauaguccuuaaauuauuuaacccuugcuaaguaauugacauauguaacaauaacuagccuaaagaaacccaaaaaaguaucucucccgagcugaaacuuaaaaauucguaaguguaagaaagaaugugagaauauauuaaaugcacacuguaccauuagaugaaaucuuacuugagaaauugccauaagccauauuacagaucuuacuuuguuacugaaucagauuaauuucuuguuauaauaauuuucaucauaaauuuucuauuuuuaaagccgcugguacuagaaauauucuuuuaaugcuauaucuauguaccuacugacacauuuuucuccauaaaaguacuuuuaaaaauua

SEQ ID NO: 6 - RNA, 4130 nt, homo sapien
gcucgcgcgcccaacggaccaggcuggggccgugagguaacuguugcagccagcggaggugggaggcgacacugagucuccagucccgagaggugcccgagggaaaaggaggcggcagcuaaacugguccuggagagaagccccuuccgccccucuccucagccagcaugucccggacuccgccgcuccucaguccgcgcgguggggaccccgggccguggcggccggcgcagcccugacggguugcgaaccagggggcgccccgaacgcggggguuggggucugggagcgcgagcggccgcuacgguacgagcggggugugcugagucccguggccacccccggccccagccaugaggagggacgagcgagacgccaaagccaugcggucccugcagccgccggauggggccggcucgccccccgagagucugaggaacggcuacgugaagagcugcgugagccccuugcggcaggacccuccgcgcggcuucuucuuccaccucugccacuucugcaacguggagcugcggccgccgccggccucuccccagcagccgcggcgcugcucccccuucugccgggcgcgccucucgcugggcgcccuggcugccuuuguccucgcccugcugcugggcgcggaacccgagagcugggcugccggggccgccuggcugcggacgcugcugagcguguguucgcacagcuugagcccccucuucagcaucgccugugccuucuucuuccucaccugcuuccucacccggaccaagcggggacccggcccgggccggagcugcggcuccugguggcugcuggcgcugcccgccugcuguuaccugggggacuucuugguguggcagugguggucuuggccuuggggggauggcgacgcaggguccgcggccccgcacacgcccccggaggcggcagcgggcagguugcugcuggugcugagcugcguagggcugcugcugacgcucgcgcacccgcugcggcugcggcacugcguucuggugcugcuccuggccagcuucgucuggugggucuccuucaccagccucgggucgcugcccuccgcccucaggccgcugcucuccggccugguggggggcgcuggcugccugcuggcccugggguuggaucacuucuuucaaaucagggaagcgccucuucauccucgacuguccagugccgccgaagaaaaagugccugugauccgaccccggaggagguccagcugcgugucguuaggagaaacugcagccaguuacuauggcaguugcaaaauauucaggagaccgucguugccuuguauuuccagagaacagaugauucuuugggauugggacuuaaaacaaugguauaagccucauuaucaaaauucuggagguggaaauggaguugaucuuucagugcuaaaugaggcucgcaauauggugucagaucuucugacugauccaagccuuccaccacaagucauuuccucucuacggaguauuaguagcuuaaugggugcuuucucagguuccuguaggccaaagauuaauccucucacaccauuuccuggauuuuaccccuguucugaaauagaggacccagcugagaaaggggauagaaaacuuaacaagggacuaaauaggaauaguuugccaacuccacagcugaggagaagcucgggaacuucaggauugcuaccuguugaacagucuucaaggugggaucguaauaauggcaaaaggccucaccaagaauuuggcauuucaagucaaggaugcuaucuaaaugggccuuuuaauucaaaucuacugacuaucccgaagcaaaggucaucuucuguaucacugacucaccauguaggucucagaagagcugguguuuuguccagucugaguccugugaauucuuccaaccauggaccagugucuacuggcucucuaacuaaucgaucacccauagaauuuccugauacugcugauuuucuuaauaagccaagcguuaucuugcagagaucucugggcaaugcaccuaauacuccagauuuuuaucagcaacuuagaaauucugauagcaaucuguguaacagcuguggacaucaaaugcugaaauauguuucaacaucugaaucagaugguacagauugcugcaguggaaaaucaggugaagaagaaaacauuuucucgaaagaaucauucaaacuuauggaaacucaacaagaagaggaaacagagaagaaagacagcagaaaauuauuucaggaaggugauaaguggcuaacagaagaggcacagagugaacagcaaacaaauauugaacaggaaguaucacuggaccugauuuuaguagaagaguaugacucauuaauagaaaagaugagcaacuggaauuuuccaauuuuugaacuuguagaaaagaugggagagaaaucaggaaggauucucagucagguuauguauaccuuauuucaagacacugguuuauuggaaauauuuaaaauucccacucaacaauuuaugaacuauuuucgugcauuagaaaauggcuaucgagacauuccuuaucacaaucguauacaugccacagaugugcuacaugcaguuugguaucugacaacacggccaguuccuggcuuacagcagauccacaaugguuguggaacaggaaaugaaacagauucugaugguagaauuaaccaugggcgaauugcuuauauuucuucgaagagcugcucuaauccugaugagaguuauggcugccugucuucaaacauuccugcauuagaauugauggcucuauacguggcagcugccaugcaugauuaugaucacccagggaggacaaaugcauuucuaguggcuacaaaugccccucaggcaguuuuauacaaugacagaucuguucuggaaaaucaucaugcugcgucagcuuggaaucuauaucuuucucgcccagaauacaacuuccuucuucaucuugaucauguggaauucaagcgcuuucguuuuuuagucauugaagcaauccuugcuacggaucuuaaaaagcauuuugauuuucucgcagaauucaaugccaaggcaaaugauguaaauaguaauggcauagaauggaguaaugaaaaugaucgccucuugguaugccaggugugcaucaaacuggcagauauaaauggcccagcaaaaguucgagacuugcauuugaaauggacagaaggcauugucaaugaauuuuaugagcagggagaugaagaagcaaaucuuggucugcccaucaguccauucauggaucguucuucuccucaacuagcaaaacuccaagaaucuuuuaucacccacauaguggguccccuguguaacuccuaugaugcugcugguuugcuaccaggucagugguuagaagcagaagaggauaaugauacugaaaguggugaugaugaagacggugaagaauuagauacagaagaugaagaaauggaaaacaaucuaaauccaaaaccaccaagaaggaaaagcagacggcgaauauuuugucagcuaaugcaccaccucacugaaaaccacaagauauggaaggaaaucguagaggaagaagaaaaauguaaagcugaugggaauaaacugcagguggagaauuccuccuuaccucaagcagaugagauucagguaauugaagaggcagaugaagaggaauagcgacaguuugaguaaaagaaaagucauauugaagaagcccagaggguugugcccaggggcagaaaucauugccuaguguucacuggcugacucucaacugaccauucccauguggacaggccuuaauacugugagaggauccuugcucugcuggcaguuucccacuccuaugcacuuucacaggaacuagaaaacuauucuuaaaccaaaaauaccauccguguugacccauguugcagagcccuuacuuaaauccuucacugguguaugaauacuuugucauaaugcugcuuugcuggguagugagcucuuauuuuuaacugggggucagcuauaacuaaaaacucaagugacauauuucaguuaccaaaguggccaggaacuuuuugcuuuuaugaaaauagauucauauuguauuucccaaaaaaaaaaaaaaaa

SEQ ID NO: 7 - RNA, 4784 nt, homo sapien
gaggcgacacugagucuccaaguccggagaggugcccgagggaaaagaggcggcagcuaaacugguccuggagagaagccccuuccgccccucuccucagccagcaugucccggacuccgccgcuccucaguccgcgcgguggggaccccgggccguggcggccggcgcagcccugacggguugcgaaccagggggcgccccgaacgcggggguuggggucugggagcgcgagcggccgcuacgguacgagcggggugugcugagucccguggccacccccggccccagccaugaggagggacgagcgagacgccaaagccaugcggucccugcagccgccggauggggccggcucgccccccgagagucugaggaacggcuacgugaagagcugcgugagccccuugcggcaggacccuccgcgcggcuucuucuuccaccucugccgcuucugcaacguggagcugcggccgccgccggccucuccccagcagccgcggcgcugcucccccuucugccgggcgcgccucucgcugggcgcccuggcugccuuuguccucgcccugcugcugggcgcggaacccgagagcugggcugccggggccgccuggcugcggacgcugcugagcguguguucgcacagcuugagcccccucuucagcaucgccugugccuucuucuuccucaccugcuuccucacccggaccaagcggggacccggcccgggccggagcugcggcuccugguggcugcuggcgcugcccgccugcuguuaccugggggacuucuugguguggcagugguggucuuggccuuggggggauggcgacgcaggguccgcggccccgcacacgcccccggaggcggcagcgggcagguugcugcuggugcugagcugcguagggcugcugcugacgcucgcgcacccgcugcggcuccggcacugcguucuggugcugcuccuggccagcuucgucuggugggucuccuucaccagccucgggucgcugcccuccgcccucaggccgcugcucuccggccugguggggggcgcuggcugccugcuggcccugggguuggaucacuucuuucaaaucagggaagcgccucuucauccucgacuguccagugccgccgaagaaaaagugccugugauccgaccccggaggagguccagcugcgugucguuaggagaaacugcagccaguuacuauggcaguugcaaaauauucaggagaccgucguugccuuguauuuccagagaacagaugauucuuugggauugggacuuaaaacaaugguauaagccucauuaucaaaauucuggagguggaaauggaguugaucuuucagugcuaaaugaggcucgcaauauggugucagaucuucugacugauccaagccuuccaccacaagucauuuccucucuacggaguauuaguagcuuaaugggugcuuucucagguuccuguaggccaaagauuaauccucucacaccauuuccuggauuuuaccccuguucugaaauagaggacccagcugagaaaggggauagaaaacuuaacaagggacuaaauaggaauaguuugccaacuccacagcugaggagaagcucaggaacuucaggauugcuaccuguugaacagucuucaaggugggaucguaauaauggcaaaaggccucaccaagaauuuggcauuucaagucaaggaugcuaucuaaaugggccuuuuaauucaaaucuacugacuaucccgaagcaaaggucaucuucuguaucacugacucaccauguaggucucagaagagcugguguuuuguccagucugaguccugugaauucuuccaaccauggaccagugucuacuggcucucuaacuaaucgaucacccauagaauuuccugauacugcugauuuucuuaauaagccaagcguuaucuugcagagaucucugggcaaugcaccuaauacuccagauuuuuaucagcaacuuagaaauucugauagcaaucuguguaacagcuguggacaucaaaugcugaaauauguuucaacaucugaaucagaugguacagauugcugcaguggaaaaucaggugaagaagaaaacauuuucucgaaagaaucauucaaacuuauggaaacucaacaagaagaggaaacagagaagaaagacagcagaaaauuauuucaggaaggugauaaguggcuaacagaagaggcacagagugaacagcaaacaaauauugaacaggaaguaucacuggaccugauuuuaguagaagaguaugacucauuaauagaaaagaugagcaacuggaauuuuccaauuuuugaacuuguagaaaagaugggagagaaaucaggaaggauucucagucagguuauguauaccuuauuucaagacacugguuuauuggaaauauuuaaaauucccacucaacaauuuaugaacuauuuucgugcauuagaaaauggcuaucgagacauuccuuaucacaaucguauacaugccacagaugugcuacaugcaguuugguaucugacaacacggccaguuccuggcuuacagcagauccacaaugguuguggaacaggaaaugaaacagauucugaugguagaauuaaccaugggcgaauugcuuauauuucuucgaagagcugcucuaauccugaugagaguuauggcugccugucuucaaacauuccugcauuagaauugauggcucuauacguggcagcugccaugcaugauuaugaucacccagggaggacaaaugcauuucuaguggcuacaaaugccccucaggcaguuuuauacaaugacagaucuguucuggaaaaucaucaugcugcgucagcuuggaaucuauaucuuucucgcccagaauacaacuuccuucuucaucuugaucauguggaauucaagcgcuuucguuuuuuagucauugaagcaauccuugcuacggaucuuaaaaagcauuuugauuuucucgcagaauucaaugccaaggcaaaugauguaaauaguaauggcauagaauggaguaaugaaaaugaucgccucuugguaugccaggugugcaucaaacuggcagauauaaauggcccagcaaaaguucgagacuugcauuugaaauggacagaaggcauugucaaugaauuuuaugagcagggagaugaagaagcaaaucuuggucugcccaucaguccauucauggaucguucuucuccucaacuagcaaaacuccaagaaucuuuuaucacccacauaguggguccccuguguaacuccuaugaugcugcugguuugcuaccaggucagugguuagaagcagaagaggauaaugauacugaaaguggugaugaugaagacggugaagaauuagauacagaagaugaagaaauggaaaacaaucuaaauccaaaaccaccaagaaggaaaagcagacggcgaauauuuugucagcuaaugcaccaccucacugaaaaccacaagauauggaaggaaaucguagaggaagaagaaaaauguaaagcugaugggaauaaacugcagguggagaauuccuccuuaccucaagcagaugagauucagguaauugaagaggcagaugaagaggaauagcgacaguuugaguaaaagaaaagucauauugaagaagcccagaggguugugcccaggggcagaaaucauugccuaguguucaccggcugacucucaacugaccauucccauguggacaggccuuaauacugugagaggauccuugcucugcuggcaguuucccacuccuaugcacuuucacaggaacuagaaaacuauucuuaaaccaaaaauaccauccguguugacccauguugcagagcccuuacuuaaauccuucacugguguaugaauacuuugucauaaugcugcuuugcuggguagugagcucuuauuuuucacugggggucagcuauaacuaaaaacucaagugacauauuucaguuaccaaaguggccaggaacuuuuugcuuuuaugaaaauagauucauauuguauuucccagugugucuuuuaugucuuugaauguuuuggagaaaagucuaugccugucuaaaaaugaauccaguguugccuuucugagggauuucugcucaaugcaauacacuguucagugcuauucucccagcuagguuuauccaugaaggacugagugaccuuuguuguauuuaacaaaauccaggugcaucaauuucugaugcuuuuuacuauuguguauuaucuacuauguguguuuuauuucugcugagaguauucagguuugccauggacaucagaaguuugaauuccagucuuaucuuauguuccauggcugaauuuuaaagcuguuuagguuuaacaaugaagggauuuauucuuuagucaaaauuguuguuuuuacucuagcucaggauucguauuuuuaaagauuuaguuaauauaaacacagcacagauuugucagaagaaaaaaaauuugcuguaauaccaaaacuaaccucaucaaagauacagaaaaaaagaaauauagugagcccuaaaggacacauacauugaauaaauaauuggaacaugugguuaucuuuagauccacaucuuagcugucauuuguucacucuaaaacugauguucaucuuucuguuaauuucccucugccuaaagaguacaugacagaaaugaccuaucacuacuuauuauuucugaagccuaacugcaagagugauuucuugagaacaaguaaagaacuggcucgugccg

SEQ ID NO: 8 - RNA, 3819 nt, homo sapien
agaggcggcagcuaaacugguccuggagagaagccccuuccgccccucuccucagccagcaugucccggacuccgccgcuccucaguccgcgcgguggggaccccgggccguggcggccggcgcagcccugacggguugcgaaccagggggcgccccgaacgcggggguuggggucugggagcgcgagcggccgcuacgguacgagcggggugugcugagucccguggccacccccggccccagccaugaggagggacgagcgagacgccaaagccaugcggucccugcagccgccggauggggccggcucgccccccgagagucugaggaacggcuacgugaagagcugcgugagccccuugcggcaggacccuccgcgcggcuucuucuuccaccucugccgcuucugcaacguggagcugcggccgccgccggccucuccccagcagccgcggcgcugcucccccuucugccgggcgcgccucucgcugggcgcccuggcugccuuuguccucgcccugcugcugggcgcggaacccgagagcugggcugccggggccgccuggcugcggacgcugcugagcguguguucgcacagcuugagcccccucuucagcaucgccugugccuucuucuuccucaccugcuuccucacccggaccaagcggggacccggcccgggccggagcugcggcuccugguggcugcuggcgcugcccgccugcuguuaccugggggacuucuugguguggcagugguggucuuggccuuggggggauggcgacgcaggguccgcggccccgcacacgcccccggaggcggcagcgggcagguugcugcuggugcugagcugcguagggcugcugcugacgcucgcgcacccgcugcggcuccggcacugcguucuggugcugcuccuggccagcuucgucuggugggucuccuucaccagccucgggucgcugcccuccgcccucaggccgcugcucuccggccugguggggggcgcuggcugccugcuggcccugggguuggaucacuucuuucaaaucagggaagcgccucuucauccucgacuguccagugccgccgaagaaaaagugccugugauccgaccccggaggagguccagcugcgugucguuaggagaaacugcagccaguuacuauggcaguugcaaaauauucaggagaccgucguugccuuguauuuccagagaacagaugauucuuugggauugggacuuaaaacaaugguauaagccucauuaucaaaauucuggagguggaaauggaguugaucuuucagugcuaaaugaggcucgcaauauggugucagaucuucugacugauccaagccuuccaccacaagucauuuccucucuacggaguauuaguagcuuaaugggugcuuucucagguuccuguaggccaaagauuaauccucucacaccauuuccuggauuuuaccccuguucugaaauagaggacccagcugagaaaggggauagaaaacuuaacaagggacuaaauaggaauaguuugccaacuccacagcugaggagaagcucaggaacuucaggauugcuaccuguugaacagucuucaaggugggaucguaauaauggcaaaagaccucaccaagaauuuggcauuucaagucaaggaugcuaucuaaaugggccuuuuaauucaaaucuacugacuaucccgaagcaaaggucaucuucuguaucacugacucaccauguaggucucagaagagcugguguuuuguccagucugaguccugugaauucuuccaaccauggaccagugucuacuggcucucuaacuaaucgaucacccauagaauuuccugauacugcugauuuucuuaauaagccaagcguuaucuugcagagaucucugggcaaugcaccuaauacuccagauuuuuaucagcaacuuagaaauucugauagcaaucuguguaacagcuguggacaucaaaugcugaaauauguuucaacaucugaaucagaugguacagauugcugcaguggaaaaucaggugaagaagaaaacauuuucucgaaagaaucauucaaacuuauggaaacucaacaagaagaggaaacagagaagaaagacagcagaaaauuauuucaggaaggugauaaguggcuaacagaagaggcacagagugaacagcaaacaaauauugaacaggaaguaucacuggaccugauuuuaguagaagaguaugacucauuaauagaaaagaugagcaacuggaauuuuccaauuuuugaacuuguagaaaagaugggagagaaaucaggaaggauucucagucagguuauguauaccuuauuucaagacacugguuuauuggaaauauuuaaaauucccacucaacaauuuaugaacuauuuucgugcauuagaaaauggcuaucgagacauuccuuaucacaaucguauacaugccacagaugugcuacaugcaguuugguaucugacaacacggccaguuccuggcuuacagcagauccacaaugguuguggaacaggaaaugaaacagauucugaugguagaauuaaccaugggcgaauugcuuauauuucuucgaagagcugcucuaauccugaugagaguuauggcugccugucuucaaacauuccugcauuagaauugauggcucuauacguggcagcugccaugcaugauuaugaucacccagggaggacaaaugcauuucuaguggcuacaaaugccccucaggcaguuuuauacaaugacagaucuguucuggaaaaucaucaugcugcgucagcuuggaaucuauaucuuucucgcccagaauacaacuuccuucuucaucuugaucauguggaauucaagcgcuuucguuuuuuagucauugaagcaauccuugcuacggaucuuaaaaagcauuuugauuuucucgcagaauucaaugccaaggcaaaugauguaaauaguaauggcauagaauggaguaaugaaaaugaucgccucuugguaugccaggugugcaucaaacuggcagauauaaauggcccagcaaaaguucgagacuugcauuugaaauggacagaaggcauugucaaugaauuuuaugagcagggagaugaagaagcaaaucuuggucugcccaucaguccauucauggaucguucuucuccucaacuagcaaaacuccaagaaucuuuuaucacccacauaguggguccccuguguaacuccuaugaugcugcugguuugcuaccaggucagugguuagaagcagaagaggauaaugauacugaaaguggugaugaugaagacggugaagaauuagauacagaagaugaagaaauggaaaacaaucuaaauccaaaaccaccaagaaggaaaagcagacggcgaauauuuugucagcuaaugcaccaccucacugaaaaccacaagauauggaaggaaaucguagaggaagaagaaaaauguaaagcugaugggaauaaacugcagguggagaauuccuccuuaccucaagcagaugagauucagguaauugaagaggcagaugaagaggaauagcgacaguuugaguaaaagaaaagucauauugaagaagcccagaggguugugcccaggggcagaaaucauugccuaguguucaccggcugacucucaacugaccauucccauguggacaggccuuaauacugugagaggauccuugcucugcuggcaguuucccacuccuaugcacuuucacaggaacuagaaaacuauucuuaaaccaaaaauaccauccguguugacccaugu

SEQ ID NO: 9 - RNA, 3666 nt, homo sapien
agaggcggcagcuaaacugguccuggagagaagccccuuccgccccucuccucagccagcaugucccggacuccgccgcuccucaguccgcgcgguggggaccccgggccguggcggccggcgcagcccugacggguugcgaaccagggggcgccccgaacgcggggguuggggucugggagcgcgagcggccgcuacgguacgagcggggugugcugagucccguggccacccccggccccagccaugaggagggacgagcgagacgccaaagccaugcggucccugcagccgccggauggggccggcucgccccccgagagucugaggaacggcuacgugaagagcugcgugagccccuugcggcaggacccuccgcgcggcuucuucuuccaccucugccgcuucugcaacguggagcugcggccgccgccggccucuccccagcagccgcggcgcugcucccccuucugccgggcgcgccucucgcugggcgcccuggcugccuuuguccucgcccugcugcugggcgcggaacccgagagcugggcugccggggccgccuggcugcggacgcugcugagcguguguucgcacagcuugagcccccucuucagcaucgccugugccuucuucuuccucaccugcuuccucacccggaccaagcggggacccggcccgggccggagcugcggcuccugguggcugcuggcgcugcccgccugcuguuaccugggggacuucuugguguggcagugguggucuuggccuuggggggauggcgacgcaggguccgcggccccgcacacgcccccggaggcggcagcgggcagguugcugcuggugcugagcugcguagggcugcugcugacgcucgcgcacccgcugcggcuccggcacugcguucuggugcugcuccuggccagcuucgucuggugggucuccuucaccagccucgggucgcugcccuccgcccucaggccgcugcucuccggccugguggggggcgcuggcugccugcuggcccugggguuggaucacuucuuucaaaucagggaagcgccucuucauccucgacuguccagugccgccgaagaaaaagugccugugauccgaccccggaggagguccagcugcgugucguuaggagaaacugcagccaguuacuauggcaguugcaaaauauucaggagaccgucguugccuuguauuuccagagaacagaugauucuuugggauugggacuuaaaacaaugguauaagccucauuaucaaaauucuggagguggaaauggaguugaucuuucagugcuaaaugaggcucgcaauauggugucagaucuucugacugauccaagccuuccaccacaaggacuaaauaggaauaguuugccaacuccacagcugaggagaagcucaggaacuucaggauugcuaccuguugaacagucuucaaggugggaucguaauaauggcaaaaggccucaccaagaauuuggcauuucaagucaaggaugcuaucuaaaugggccuuuuaauucaaaucuacugacuaucccgaagcaaaggucaucuucuguaucacugacucaccauguaggucucagaagagcugguguuuuguccagucugaguccugugaauucuuccaaccauggaccagugucuacuggcucucuaacuaaucgaucacccauagaauuuccugauacugcugauuuucuuaauaagccaagcguuaucuugcagagaucucugggcaaugcaccuaauacuccagauuuuuaucagcaacuuagaaauucugauagcaaucuguguaacagcuguggacaucaaaugcugaaauauguuucaacaucugaaucagaugguacagauugcugcaguggaaaaucaggugaagaagaaaacauuuucucgaaagaaucauucaaacuuauggaaacucaacaagaagaggaaacagagaagaaagacagcagaaaauuauuucaggaaggugauaaguggcuaacagaagaggcacagagugaacagcaaacaaauauugaacaggaaguaucacuggaccugauuuuaguagaagaguaugacucauuaauagaaaagaugagcaacuggaauuuuccaauuuuugaacuuguagaaaagaugggagagaaaucaggaaggauucucagucagguuauguauaccuuauuucaagacacugguuuauuggaaauauuuaaaauucccacucaacaauuuaugaacuauuuucgugcauuagaaaauggcuaucgagacauuccuuaucacaaucguauacaugccacagaugugcuacaugcaguuugguaucugacaacacggccaguuccuggcuuacagcagauccacaaugguuguggaacaggaaaugaaacagauucugaugguagaauuaaccaugggcgaauugcuuauauuucuucgaagagcugcucuaauccugaugagaguuauggcugccugucuucaaacauuccugcauuagaauugauggcucuauacguggcagcugccaugcaugauuaugaucacccagggaggacaaaugcauuucuaguggcuacaaaugccccucaggcaguuuuauacaaugacagaucuguucuggaaaaucaucaugcugcgucagcuuggaaucuauaucuuucucgcccagaauacaacuuccuucuucaucuugaucauguggaauucaagcgcuuucguuuuuuagucauugaagcaauccuugcuacggaucuuaaaaagcauuuugauuuucucgcagaauucaaugccaaggcaaaugauguaaauaguaauggcauagaauggaguaaugaaaaugaucgccucuugguaugccaggugugcaucaaacuggcagauauaaauggcccagcaaaaguucgagacuugcauuugaaauggacagaaggcauugucaaugaauuuuaugagcagggagaugaagaagcaaaucuuggucugcccaucaguccauucauggaucguucuucuccucaacuagcaaaacuccaagaaucuuuuaucacccacauaguggguccccuguguaacuccuaugaugcugcugguuugcuaccaggucagugguuagaagcagaagaggauaaugauacugaaaguggugaugaugaagacggugaagaauuagauacagaagaugaagaaauggaaaacaaucuaaauccaaaaccaccaagaaggaaaagcagacggcgaauauuuugucagcuaaugcaccaccucacugaaaaccacaagauauggaaggaaaucguagaggaagaagaaaaauguaaagcugaugggaauaaacugcagguggagaauuccuccuuaccucaagcagaugagauucagguaauugaagaggcagaugaagaggaauagcgacaguuugaguaaaagaaaagucauauugaagaagcccagaggguugugcccaggggcagaaaucauugccuaguguucaccggcugacucucaacugaccauucccauguggacaggccuuaauacugugagaggauccuugcucugcuggcaguuucccacuccuaugcacuuucacaggaacuagaaaacuauucuuaaaccaaaaauaccauccguguugacccaugu

SEQ ID NO: 10 - RNA, 3339 nt, homo sapien
augaggagggacgagcgagacgccaaagccaugcggucccugcagccgccggauggggccggcucgccccccgagagucugaggaacggcuacgugaagagcugcgugagccccuugcggcaggacccuccgcgcggcuucuucuuccaccucugccgcuucugcaacguggagcugcggccgccgccggccucuccccagcagccgcggcgcugcucccccuucugccgggcgcgccucucgcugggcgcccuggcugucuuuguccucgcccugcugcugggcgcggaacccgagagcugggcugccggggccgccuggcugcggacgcugcugagcguguguucgcacagcuugagcccccucuucagcaucgccugugccuucuucuuccucaccugcuuccucacccggaccaagcggggacccggcccgggccggagcugcggcuccugguggcugcuggcgcugcccgccugcuguuaccugggggacuucuugguguggcagugguggucuuggccuuggggggauggcgacgcaggguccgcggccccgcacacgcccccggaggcggcagcgggcagguugcugcuggugcugagcugcguagggcugcugcugacgcucgcgcacccgcugcggcuccggcacugcguucuggugcugcuccuggccagcuucgucuggugggucuccuucaccagccucgggucgcugcccuccgcccucaggccgcugcucuccggccugguggggggcgcuggcugccugcuggcccugggguuggaucacuucuuucaaaucagggaagcgccucuucauccucgacuguccagugccgccgaagaaaaagugccugugauccgaccccggaggagguccagcugcgugucguuaggagaaacugcagccaguuacuauggcaguugcaaaauauucaggagaccgucguugccuuguauuuccagagaacagaugauucuuugggauugggacuuaaaacaaugguauaagccucauuaucaaaauucuggagguggaaauggaguugaucuuucagugcuaaaugaggcucgcaauauggugucagaucuucugacugauccaagccuuccaccacaagucauuuccucucuacggaguauuaguagcuuaaugggugcuuucucagguuccuguaggccaaagauuaauccucucacaccauuuccuggauuuuaccccuguucugaaauagaggacccagcugagaaaggggauagaaaacuuaacaagggacuaaauaggaauaguuugccaacuccacagcugaggagaagcucaggaacuucaggauugcuaccuguugaacagucuucaaggugggaucguaauaauggcaaaaggccucaccaagaauuuggcauuucaagucaaggaugcuaucuaaaugggccuuuuaauucaaaucuacugacuaucccgaagcaaaggucaucuucuguaucacugacucaccauguaggucucagaagagcugguguuuuguccagucugaguccugugaauucuuccaaccauggaccagugucuacuggcucucuaacuaaucgaucacccauagaauuuccugauacugcugauuuucuuaauaagccaagcguuaucuugcagagaucucugggcaaugcaccuaauacuccagauuuuuaucagcaacuuagaaauucugauagcaaucuguguaacagcuguggacaucaaaugcugaaauauguuucaacaucugaaucagaugguacagauugcugcaguggaaaaucaggugaagaagaaaacauuuucucgaaagaaucauucaaacuuauggaaacucaacaagaagaggaaacagagaagaaagacagcagaaaauuauuucaggaaggugauaaguggcuaacagaagaggcacagagugaacagcaaacaaauauugaacaggaaguaucacuggaccugauuuuaguagaagaguaugacucauuaauagaaaagaugagcaacuggaauuuuccaauuuuugaacuuguagaaaagaugggagagaaaucaggaaggauucucagucagguuauguauaccuuauuucaagacacugguuuauuggaaauauuuaaaauucccacucaacaauuuaugaacuauuuucgugcauuagaaaauggcuaucgagacauuccuuaucacaaucguauacaugccacagaugugcuacaugcaguuugguaucugacaacgcggccaguuccuggcuuacagcagauccacaaugguuguggaacaggaaaugaaacagauucugaugguagaauuaaccaugggcgaauugcuuauauuucuucgaagagcugcucuaauccugaugagaguuauggcugccugucuucaaacauuccugcauuagaauugauggcucuauacguggcagcugccaugcaugauuaugaucacccagggaggacaaaugcauuucuaguggcuacaaaugccccucaggcaguuuuauacaaugacagaucuguucuggaaaaucaucaugcugcgucagcuuggaaucuauaucuuucucgcccagaauacaacuuccuucuucaucuugaucauguggaauucaagcgcuuucguuuuuuagucauugaagcaauccuugcuacggaucuuaaaaagcauuuugauuuucucgcagaauucaaugccaaggcaaaugauguaaauaguaauggcauagaauggaguaaugaaaaugaucgccucuugguaugccaggugugcaucaaacuggcagauauaaauggcccagcaaaaguucgagacuugcauuugaaauggacagaaggcauugucaaugaauuuuaugagcagggagaugaagaagcaaaucuuggucugcccaucaguccauucauggaucguucuucuccucaacuagcaaaacuccaagaaucuuuuaucacccacauaguggguccccuguguaacuccuaugaugcugcugguuugcuaccaggucagugguuagaagcagaagaggauaaugauacugaaaguggugaugaugaagacggugaagaauuagauacagaagaugaagaaauggaaaacaaucuaaauccaaaaccaccaagaaggaaaagcagacggcgaauauuuugucagcuaaugcaccaccucacugaaaaccacaagauauggaaggaaaucguagaggaagaagaaaaauguaaagcugaugggaauaaacugcagguggagaauuccuccuuaccucaagcagaugagauucagguaauugaagaggcagaugaagaggaauag

SEQ ID NO: 11 - RNA, 5521 nt, homo sapien
cgccggccucuccccagcagccgcggcgcugcucccccuucugccgggcgcgccucucgcugggcgcccuggcugccuuuguccucgcccugcugcugggcgcggaacccgagagcugggcugccggggccgccuggcugcggacgcugcugagcguguguucgcacagcuugagcccccucuucagcaucgccugugccuucuucuuccucaccugcuuccucacccggaccaagcggggacccggcccgggccggagcugcggcuccugguggcugcuggcgcugcccgccugcuguuaccugggggacuucuugguguggcagugguggucuuggccuuggggggauggcgacgcaggguccgcggccccgcacacgcccccggaggcggcagcgggcagguugcugcuggugcugagcugcguagggcugcugcugacgcucgcgcacccgcugcggcuccggcacugcguucuggugcugcuccuggccagcuucgucuggugggucuccuucaccagccucgggucgcugcccuccgcccucaggccgcugcucuccggccugguggggggcgcuggcugccugcuggcccugggguuggaucacuucuuucaaaucagggaagcgccucuucauccucgacuguccagugccgccgaagaaaaagugccugugauccgaccccggaggagguccagcugcgugucguuaggagaaacugcagccaguuacuauggcaguugcaaaauauucaggagaccgucguugccuuguauuuccagagaacagaugauucuuugggauugggacuuaaaacaaugguauaagccucauuaucaaguaaguauaauuaauaucugugaugaauaucuaaauaauaucugugaucacuaaauaauaucugugaugcaacuuuugacacuuaaaguuacacucacaauauuucugugccauaagauuuucuuuaacuaaacuaauaaguuaacuagaaccuucauugagguagauuuuuuaaaaauauauuuuaauuauaagggaaaaagaaaaugauaaaaacaaaauuuauauaaauuguuaugaaaaauauugcuaauauaaucugggcucagaaucaacuaauauuucuauauuaaggauaagauuuuuuucuuuucugauguggaccacuguucuauaaaggggaaaaaauagauggaaggccauaucugagacaaagcaaagcaguuggcaacauauuuuauuagggaaguaaagauauccaacuuucauuuuuugguaaacuuuuuaucaaauuauaacauacaugcaggaaaguguacagcucaauuuucagaaguuaaacaucccauguaacugguacugauaugaagaaauagaauguuuccaguaucucagaagccucacauaugcccaauuccagucauuaccuauauccccaaagauaaauccuauccgacuucuaauaacuaguuuugcuaauuuuugaacuuuauauauacacaaauggaauaauauguguacuuuuuuaggauuaauuuuuugaacaccuaaguaauauauguuuauaucagauaaaaugaaaauagaaguauuuaauauaaggagaaaaaaggaaaaucacucauaaaacaucaagcaauaacuguguuaacuuuugaugucuaucuuuauugaucuuucccauuaugcuaaauuuacuuaauaauucuaauagcuuauuugaagauucuuugagucuugacguacacaaaaauguuaucuaugaauaaagacagauuuauuuauuuauuucaaaaccuaugccuuuuauuucuuuuucucauguuauuguacuuucuaggaccuucaacgcaguguugaauggaagugguaugaguaggcagccuuguuuuucuucaugaacucagggaaaaaauguucaacauaucaccacuaauguuuuuuguagauacccuuuagcagauuaaggaaguuuuauucuaauucuaguuuacuaaggacuuuuuuucucuuaaguuaugaguggguauauaauuuuaucagaugcuuuuucugcaucuauucaaaugauucgagauuuuuuucuaauuauucuacuaauguggugaauuacauuguuuauguuuguuaaaccaucccuguauucccagaauaaaguaaauuugaucaagauguauuuuguuuaaauauuuaucacuagauucuauuuguuaauguuuuguuuagaaauuuugaauuuguguuuaugagagaguguuggccuauaaauucuuacuuuucauaauguucuuggcauuauauugguaucacgguuaccaagaaccuugauaucaagauaaaauaaggugagauauuuacccuuucuauuaccucgaaaaguuuggguaagauuaaaaauugguauuauuuccuccuuuaauguuuggaagaaugcucuggugaagcuaucucaccuugaagaauuauuuuguggucaaauuuuaaguuauggauucaauuucuuuaauaguuuuaguaucauuuagauuuuccaucuuuucuucuaacaauugaguuacuuguguuuuucuaggaauuccuuuuuuuguuguuguuccuucuggcauuugugagacugcugaaagcccuauuuuaauuucaaaauagaaaucuuuuugaggauuucuacuugguuuaucucucucuuagccacuguuuauaaauuggcaaauaccuuuagaggaaaagcaggucugaauuuaagcucacuacuuuguuuuucucaucacuuugggaucuuguuuggcacccccugucuucauagcucugaacuccaauuucggucucccagccccuugggacuauagaucucuacucuguuuucuggccucuuuugugcuucucauccucucugcucugugccaguuaugaaucagcagaaaauuccuagagggaaaagaguagcacagaauguuggauuucuuuuaaucuuuucucuuaauucuggguucuuggccuuuuaugcccuggcuguuugguuguguuuugaugccuugaaauguaugcuauuuauauuuuauuucagcuuuucuaguuguucuagacagaagaguuggucugauacaaaccagucccucuuagcuggaaaauuaggcaagccucuuaagacacucugaaccuauucccucaccuacaaauugagaauaauaccaguucccucaaagggcuaauuaauaugugccugguacuuaauacaaaugugggccaauauuauauaaauuucaauaguaauaaauacuaaucugaacuugaaguauaagacaggaaugagcauuuuuuucuuuaaaaggccagagaguaaguauuuuagcauuugcuggaaacauaugaccauugcuaccuuuugccguccccagugcuucucauugccuccuuuguccucuucucccucccacuccucuucuuuuucaauaaccauuuaaaacauaaaaacuauucuuaacuuucuguucaacaaucaagauuuugcuaaauauaagugaauggaaaauaggaauuuaaguucagcuuuuaaaauuguggcaaauaauuugaauauucaauuugaucugccauaaguuaucaugucacucucuugcucauuucucucguuucacccaguguaaaagucuuugucauguacguaaaagaacuuacacaacaugguucccucccuuacucucuuguacuucucugucuuugucuucuacuacuuucuccuucauuuacucuguuccagcugcacuggccuccuuguuauuccccaaacaagucagacaggcuucugacucaggucuuugcacuugcuagucucucugccugggaugcuuauuucccacacuuugucaugucuuuacauaagcauuuccuucuuagugaggcauaccccaacuauccucucuaaaauugcauugcguucuaucacaucuuuuucccuuaacuuacuuuauuuucucuuuuuagcagcuuguucaaaaucuauuauauacgacccuuuauuacucauauuacuuagcuuggaauccaguguucucaaaaauuuggucccaacaugucuuuccaaccuguuuuucauugcuuucuuauauaaucuguacuucaacaauuucauauucccuguauagcauuauuuuaccacuuaaaaauuguauuuuaccacuuuuauacuuuuauuuaugcuguguccauuuugugcaguacacuuccccaauacauuuuuguuuuguuuuauuguaaacaaauauaaauauaauccuaccaaauuuuuagggcccagcucaaaugcuaccccuuccauaaaauuucuguuaccauccaaauggaagguuucuauaucucuuuugaacgcuaaugccauuuugucuguauauauaauuuuuuucuuuuuuugagacgaaguuucucucuuguugcccaggcuggagugcaguggcaugaucucggcucaccgcaaccuccagcucccugguucaagcgauucuccugccucagccuccggaguagcugggauuacaggcaugugccaccacacccggcuaauuuuguauuuuuaguagagaugggauuucuccauguuggucaggcuggucuugaacucccgaccucaggugaucugcccaccucggccucccaaagugcugggauuacagggguaagagaccacacuuggccauuuugucuguauuuuuaucucuucacuuucuguuaauaauaacaguacuaucuuugccuuuaguuauauauacuauacuuuauaugcucugcauguguuaccauauguaacucucucuuuuccuccuugcuaaguacaguuauuaagucuggaaauaauguaagaggcaaucaagugagaacuacaaaaaauagaaagaggaaggcagacuggcuagggacccuaguacaggaaaaacaacacagugacagagucucuuaugacccacacccaacagcaaaccuggucuaggcccccacucucaaccuagcaacauaaggugacacagguaggcuuauucuuuccccagauuaaacaagagcccugccaacacuaggcaagucugguggcucuagcaagggggaauugauuuggaaccacuggcaaucagugaccagggagaagcauucuccuucccuccugggcaugagacuccccuuccccacugacagacacuggguggccagugugccuggcaagggggauguccucacaaaugccuagcccagaaagugaucuuugauccugucaccuggagacuccuuucucuccccuaaagguaccagaugacccaaccugaggaagcucucuuucccccuacuguaaggcaccaguguggacuguggacuagugggaacccaacgggcaccaaaugcuagaugacgaguuagugggugcagcgcaccagcauggcacauguauacauauguaacuaaccugcacaaugugcacauguacccuaaaacuuaaaguauaauuaaaaaauaauaauaauaauaguaauaau

SEQ ID NO: 12 - DNA, 5995 bp, homo sapien
agtcccgagaggtgcccgagggaaaaggaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaagggactaaataggaatagtttgccaactccacagctgaggagaagctcaggaacttcaggattgctacctgttgaacagtcttcaaggtgggatcgtaataatggcaaaagacctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatatgaacacagcacagatttgttagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactggaatacttatttttcatataaaaatctaaatgtgttaataaatcatttcatacaaaagtacattattaaataaccacattattaaaataattgcaagaaaatggaccatatttacaatgttttgtaaacttgctagtgtgtggatatgtaccctacttgtgaaatacatttgaagatataaagagcagccaaaatgatggcaaaatggtaggctaatattttctattattattggagaacatatcatattttggaatcatgcaattttgcacacagtgaaaccattaattttccaaggtaattcctttagaatatggtattggcatgcagtttcttacttatctagaatatttggcttatctgaaagatatcaatttaagatctctggaagtgttagaatttttgatccttcacagtgtcaatatttaatgaatcactaagctttatttattagacgtgttgagtgagtgctgagttccttgctgccacttttgttaccattgtcacacactatgtgtaaaccagtcccaccacttattactaataaaattttgactgataatttatatttgcacttacaatatatatatcctgtccttatatttctctagagtacattttccatcatgtttaagtgtatttctgctattatttcctctcctgcagaatacatacaagtgtatgtgtataaagtcatacatgtacaagcatgcatattgagattgaatcacatttccatactgtctgttattttattgggttttatattgggtttctttagtttatgttgttttctcaaaagcagcattttaaattacgaatactggacttattggatttaattataaatccaattactactggaaactcatttttacataatatagtccttaaattatttaacccttgctaagtaattgacatatgtaacaataactagcctaaagaaacccaaaaaagtatctctcccgagctgaaacttaaaaattcgtaagtgtaagaaagaatgtgagaatatattaaatgcacactgtaccattagatgaaatcttacttgagaaattgccataagccatattacagatcttactttgttactgaatcagattaatttcttgttataataattttcatcataaattttctatttttaaagccgctggtactagaaatattcttttaatgctatatctatgtacctactgacacatttttctccataaaagtacttttaaaaatta

SEQ ID NO: 13 - DNA, 3665 bp, homo sapien
gaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaaggactaaataggaatagtttgccaactccacagctgaggagaagctcaggaacttcaggattgctacctgttgaacagtcttcaaggtgggatcgtaataatggcaaaagacctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgt

SEQ ID NO: 14 - DNA, 5842 bp, homo sapien
agtcccgagaggtgcccgagggaaaaggaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaaggactaaataggaatagtttgccaactccacagctgaggagaagctcaggaacttcaggattgctacctgttgaacagtcttcaaggtgggatcgtaataatggcaaaagacctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatatgaacacagcacagatttgttagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactggaatacttatttttcatataaaaatctaaatgtgttaataaatcatttcatacaaaagtacattattaaataaccacattattaaaataattgcaagaaaatggaccatatttacaatgttttgtaaacttgctagtgtgtggatatgtaccctacttgtgaaatacatttgaagatataaagagcagccaaaatgatggcaaaatggtaggctaatattttctattattattggagaacatatcatattttggaatcatgcaattttgcacacagtgaaaccattaattttccaaggtaattcctttagaatatggtattggcatgcagtttcttacttatctagaatatttggcttatctgaaagatatcaatttaagatctctggaagtgttagaatttttgatccttcacagtgtcaatatttaatgaatcactaagctttatttattagacgtgttgagtgagtgctgagttccttgctgccacttttgttaccattgtcacacactatgtgtaaaccagtcccaccacttattactaataaaattttgactgataatttatatttgcacttacaatatatatatcctgtccttatatttctctagagtacattttccatcatgtttaagtgtatttctgctattatttcctctcctgcagaatacatacaagtgtatgtgtataaagtcatacatgtacaagcatgcatattgagattgaatcacatttccatactgtctgttattttattgggttttatattgggtttctttagtttatgttgttttctcaaaagcagcattttaaattacgaatactggacttattggatttaattataaatccaattactactggaaactcatttttacataatatagtccttaaattatttaacccttgctaagtaattgacatatgtaacaataactagcctaaagaaacccaaaaaagtatctctcccgagctgaaacttaaaaattcgtaagtgtaagaaagaatgtgagaatatattaaatgcacactgtaccattagatgaaatcttacttgagaaattgccataagccatattacagatcttactttgttactgaatcagattaatttcttgttataataattttcatcataaattttctatttttaaagccgctggtactagaaatattcttttaatgctatatctatgtacctactgacacatttttctccataaaagtacttttaaaaatta

SEQ ID NO: 15 - DNA, 6229 bp, homo sapien
agtcccgagaggtgcccgagggaaaaggaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaagctggagtgcagtggcatgatctcggctcaccgcaacctccagctccctggttcaagcgattctcctgcctcagcctccggagtagctgggattacaggcatgtgccaccacacctggctaattttgtatttttagtagagatgggatttctccatgttggtcaggctggtcttgaactcccgacctcaggtgatctgcccacctcggcctcccaaagtgctgggattacagggaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaagggactaaataggaatagtttgccaactccacagctgaggagaagctcaggaacttcaggattgctacctgttgaacagtcttcaaggtgggatcgtaataatggcaaaagacctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatatgaacacagcacagatttgttagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactggaatacttatttttcatataaaaatctaaatgtgttaataaatcatttcatacaaaagtacattattaaataaccacattattaaaataattgcaagaaaatggaccatatttacaatgttttgtaaacttgctagtgtgtggatatgtaccctacttgtgaaatacatttgaagatataaagagcagccaaaatgatggcaaaatggtaggctaatattttctattattattggagaacatatcatattttggaatcatgcaattttgcacacagtgaaaccattaattttccaaggtaattcctttagaatatggtattggcatgcagtttcttacttatctagaatatttggcttatctgaaagatatcaatttaagatctctggaagtgttagaatttttgatccttcacagtgtcaatatttaatgaatcactaagctttatttattagacgtgttgagtgagtgctgagttccttgctgccacttttgttaccattgtcacacactatgtgtaaaccagtcccaccacttattactaataaaattttgactgataatttatatttgcacttacaatatatatatcctgtccttatatttctctagagtacattttccatcatgtttaagtgtatttctgctattatttcctctcctgcagaatacatacaagtgtatgtgtataaagtcatacatgtacaagcatgcatattgagattgaatcacatttccatactgtctgttattttattgggttttatattgggtttctttagtttatgttgttttctcaaaagcagcattttaaattacgaatactggacttattggatttaattataaatccaattactactggaaactcatttttacataatatagtccttaaattatttaacccttgctaagtaattgacatatgtaacaataactagcctaaagaaacccaaaaaagtatctctcccgagctgaaacttaaaaattcgtaagtgtaagaaagaatgtgagaatatattaaatgcacactgtaccattagatgaaatcttacttgagaaattgccataagccatattacagatcttactttgttactgaatcagattaatttcttgttataataattttcatcataaattttctatttttaaagccgctggtactagaaatattcttttaatgctatatctatgtacctactgacacatttttctccataaaagtacttttaaaaatta

SEQ ID NO: 16 - DNA, 4130 bp, homo sapien
gctcgcgcgcccaacggaccaggctggggccgtgaggtaactgttgcagccagcggaggtgggaggcgacactgagtctccagtcccgagaggtgcccgagggaaaaggaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccacttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctgcggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaagggactaaataggaatagtttgccaactccacagctgaggagaagctcgggaacttcaggattgctacctgttgaacagtcttcaaggtgggatcgtaataatggcaaaaggcctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcactggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttaactgggggtcagctataactaaaaactcaagtgacatatttcagttaccaaagtggccaggaactttttgcttttatgaaaatagattcatattgtatttcccaaaaaaaaaaaaaaaa

SEQ ID NO: 17 - DNA, 4784 bp, homo sapien
gaggcgacactgagtctccaagtccggagaggtgcccgagggaaaagaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaagggactaaataggaatagtttgccaactccacagctgaggagaagctcaggaacttcaggattgctacctgttgaacagtcttcaaggtgggatcgtaataatggcaaaaggcctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatataaacacagcacagatttgtcagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagagtacatgacagaaatgacctatcactacttattatttctgaagcctaactgcaagagtgatttcttgagaacaagtaaagaactggctcgtgccg

SEQ ID NO: 18 - DNA, 3819 bp, homo sapien
agaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaagggactaaataggaatagtttgccaactccacagctgaggagaagctcaggaacttcaggattgctacctgttgaacagtcttcaaggtgggatcgtaataatggcaaaagacctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgt

SEQ ID NO: 19 - DNA, 3666 bp, homo sapien
agaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaaggactaaataggaatagtttgccaactccacagctgaggagaagctcaggaacttcaggattgctacctgttgaacagtcttcaaggtgggatcgtaataatggcaaaaggcctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgt

SEQ ID NO: 20 - DNA, 3339 bp, homo sapien
atgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgtctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaagggactaaataggaatagtttgccaactccacagctgaggagaagctcaggaacttcaggattgctacctgttgaacagtcttcaaggtgggatcgtaataatggcaaaaggcctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacgcggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatag

SEQ ID NO: 21 - DNA, 5521 bp, homo sapien
cgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaagtaagtataattaatatctgtgatgaatatctaaataatatctgtgatcactaaataatatctgtgatgcaacttttgacacttaaagttacactcacaatatttctgtgccataagattttctttaactaaactaataagttaactagaaccttcattgaggtagattttttaaaaatatattttaattataagggaaaaagaaaatgataaaaacaaaatttatataaattgttatgaaaaatattgctaatataatctgggctcagaatcaactaatatttctatattaaggataagatttttttcttttctgatgtggaccactgttctataaaggggaaaaaatagatggaaggccatatctgagacaaagcaaagcagttggcaacatattttattagggaagtaaagatatccaactttcattttttggtaaactttttatcaaattataacatacatgcaggaaagtgtacagctcaattttcagaagttaaacatcccatgtaactggtactgatatgaagaaatagaatgtttccagtatctcagaagcctcacatatgcccaattccagtcattacctatatccccaaagataaatcctatccgacttctaataactagttttgctaatttttgaactttatatatacacaaatggaataatatgtgtacttttttaggattaattttttgaacacctaagtaatatatgtttatatcagataaaatgaaaatagaagtatttaatataaggagaaaaaaggaaaatcactcataaaacatcaagcaataactgtgttaacttttgatgtctatctttattgatctttcccattatgctaaatttacttaataattctaatagcttatttgaagattctttgagtcttgacgtacacaaaaatgttatctatgaataaagacagatttatttatttatttcaaaacctatgccttttatttctttttctcatgttattgtactttctaggaccttcaacgcagtgttgaatggaagtggtatgagtaggcagccttgtttttcttcatgaactcagggaaaaaatgttcaacatatcaccactaatgttttttgtagataccctttagcagattaaggaagttttattctaattctagtttactaaggactttttttctcttaagttatgagtgggtatataattttatcagatgctttttctgcatctattcaaatgattcgagatttttttctaattattctactaatgtggtgaattacattgtttatgtttgttaaaccatccctgtattcccagaataaagtaaatttgatcaagatgtattttgtttaaatatttatcactagattctatttgttaatgttttgtttagaaattttgaatttgtgtttatgagagagtgttggcctataaattcttacttttcataatgttcttggcattatattggtatcacggttaccaagaaccttgatatcaagataaaataaggtgagatatttaccctttctattacctcgaaaagtttgggtaagattaaaaattggtattatttcctcctttaatgtttggaagaatgctctggtgaagctatctcaccttgaagaattattttgtggtcaaattttaagttatggattcaatttctttaatagttttagtatcatttagattttccatcttttcttctaacaattgagttacttgtgtttttctaggaattcctttttttgttgttgttccttctggcatttgtgagactgctgaaagccctattttaatttcaaaatagaaatctttttgaggatttctacttggtttatctctctcttagccactgtttataaattggcaaatacctttagaggaaaagcaggtctgaatttaagctcactactttgtttttctcatcactttgggatcttgtttggcaccccctgtcttcatagctctgaactccaatttcggtctcccagccccttgggactatagatctctactctgttttctggcctcttttgtgcttctcatcctctctgctctgtgccagttatgaatcagcagaaaattcctagagggaaaagagtagcacagaatgttggatttcttttaatcttttctcttaattctgggttcttggccttttatgccctggctgtttggttgtgttttgatgccttgaaatgtatgctatttatattttatttcagcttttctagttgttctagacagaagagttggtctgatacaaaccagtccctcttagctggaaaattaggcaagcctcttaagacactctgaacctattccctcacctacaaattgagaataataccagttccctcaaagggctaattaatatgtgcctggtacttaatacaaatgtgggccaatattatataaatttcaatagtaataaatactaatctgaacttgaagtataagacaggaatgagcatttttttctttaaaaggccagagagtaagtattttagcatttgctggaaacatatgaccattgctaccttttgccgtccccagtgcttctcattgcctcctttgtcctcttctccctcccactcctcttctttttcaataaccatttaaaacataaaaactattcttaactttctgttcaacaatcaagattttgctaaatataagtgaatggaaaataggaatttaagttcagcttttaaaattgtggcaaataatttgaatattcaatttgatctgccataagttatcatgtcactctcttgctcatttctctcgtttcacccagtgtaaaagtctttgtcatgtacgtaaaagaacttacacaacatggttccctcccttactctcttgtacttctctgtctttgtcttctactactttctccttcatttactctgttccagctgcactggcctccttgttattccccaaacaagtcagacaggcttctgactcaggtctttgcacttgctagtctctctgcctgggatgcttatttcccacactttgtcatgtctttacataagcatttccttcttagtgaggcataccccaactatcctctctaaaattgcattgcgttctatcacatctttttcccttaacttactttattttctctttttagcagcttgttcaaaatctattatatacgaccctttattactcatattacttagcttggaatccagtgttctcaaaaatttggtcccaacatgtctttccaacctgtttttcattgctttcttatataatctgtacttcaacaatttcatattccctgtatagcattattttaccacttaaaaattgtattttaccacttttatacttttatttatgctgtgtccattttgtgcagtacacttccccaatacatttttgttttgttttattgtaaacaaatataaatataatcctaccaaatttttagggcccagctcaaatgctaccccttccataaaatttctgttaccatccaaatggaaggtttctatatctcttttgaacgctaatgccattttgtctgtatatataatttttttctttttttgagacgaagtttctctcttgttgcccaggctggagtgcagtggcatgatctcggctcaccgcaacctccagctccctggttcaagcgattctcctgcctcagcctccggagtagctgggattacaggcatgtgccaccacacccggctaattttgtatttttagtagagatgggatttctccatgttggtcaggctggtcttgaactcccgacctcaggtgatctgcccacctcggcctcccaaagtgctgggattacaggggtaagagaccacacttggccattttgtctgtatttttatctcttcactttctgttaataataacagtactatctttgcctttagttatatatactatactttatatgctctgcatgtgttaccatatgtaactctctcttttcctccttgctaagtacagttattaagtctggaaataatgtaagaggcaatcaagtgagaactacaaaaaatagaaagaggaaggcagactggctagggaccctagtacaggaaaaacaacacagtgacagagtctcttatgacccacacccaacagcaaacctggtctaggcccccactctcaacctagcaacataaggtgacacaggtaggcttattctttccccagattaaacaagagccctgccaacactaggcaagtctggtggctctagcaagggggaattgatttggaaccactggcaatcagtgaccagggagaagcattctccttccctcctgggcatgagactccccttccccactgacagacactgggtggccagtgtgcctggcaagggggatgtcctcacaaatgcctagcccagaaagtgatctttgatcctgtcacctggagactcctttctctcccctaaaggtaccagatgacccaacctgaggaagctctctttccccctactgtaaggcaccagtgtggactgtggactagtgggaacccaacgggcaccaaatgctagatgacgagttagtgggtgcagcgcaccagcatggcacatgtatacatatgtaactaacctgcacaatgtgcacatgtaccctaaaacttaaagtataattaaaaaataataataataatagtaataat

SEQ ID NO: 22 - protein, 1112 aa, homo sapien
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQNSGGGNGVDLSVLNEARNMVSDLLTDPSLPPQVISSLRSISSLMGAFSGSCRPKINPLTPFPGFYPCSEIEDPAEKGDRKLNKGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 23 - protein, 1061 aa, homo sapien
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQNSGGGNGVDLSVLNEARNMVSDLLTDPSLPPQGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 24 - protein, 1190 aa, homo sapien
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQAGVQWHDLGSPQPPAPWFKRFSCLSLRSSWDYRHVPPHLANFVFLVEMGFLHVGQAGLELPTSGDLPTSASQSAGITGNSGGGNGVDLSVLNEARNMVSDLLTDPSLPPQVISSLRSISSLMGAFSGSCRPKINPLTPFPGFYPCSEIEDPAEKGDRKLNKGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 25 - protein, 298 aa, homo sapien
PASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQVSIINICDEYLNNICDH

SEQ ID NO: 26 - DNA, 20 bp, artificial sequence
  gRNA Recognition Sequence
ctgttgaacagtcttcaagg

SEQ ID NO: 27 - DNA, 20 bp, artificial sequence
  gRNA Recognition Sequence
tgatctttcagtgctaaatg

SEQ ID NO: 28 - DNA, 20 bp, artificial sequence
  gRNA Recognition Sequence
tcggcggcactggacagtcg

SEQ ID NO: 29 - DNA, 20 bp, artificial sequence
  gRNA Recognition Sequence
ttcctcacccggaccaagcg

SEQ ID NO: 30 - DNA, 20 bp, artificial sequence
  gRNA Recognition Sequence
gatctctgcaagataacgct

SEQ ID NO: 31 - DNA, 20 bp, artificial sequence
  gRNA Recognition Sequence
ctgccgggcgcgcctctcgc

SEQ ID NO: 32 - DNA, 20 bp, artificial sequence
  gRNA Recognition Sequence
tgccgggcgcgcctctcgct

SEQ ID NO: 33 - DNA, 20 bp, artificial sequence
  gRNA Recognition Sequence
gggagcagcgccgcggctgc

SEQ ID NO: 34 - DNA, 20 bp, artificial sequence
  gRNA Recognition Sequence
gccgggtccccgcttggtcc

SEQ ID NO: 35 - RNA, 20 nt, Artificial Sequence
  antisense sequence
uuuucccucgggcaccucuc

SEQ ID NO: 36 - RNA, 20 nt, Artificial Sequence
  antisense sequence
cuuuucccucgggcaccucu

SEQ ID NO: 37 - RNA, 20 nt, Artificial Sequence
  antisense sequence
uccuuuucccucgggcaccu

SEQ ID NO: 38 - RNA, 20 nt, Artificial Sequence
  antisense sequence
ccaggaccaguuuagcugcc

SEQ ID NO: 39 - RNA, 20 nt, Artificial Sequence
  antisense sequence
uccaggaccaguuuagcugc

SEQ ID NO: 40 - RNA, 20 nt, Artificial Sequence
  antisense sequence
ucuccaggaccaguuuagcu

SEQ ID NO: 41 - RNA, 20 nt, Artificial Sequence
  antisense sequence
cucuccaggaccaguuuagc

SEQ ID NO: 42 - RNA, 20 nt, Artificial Sequence
  antisense sequence
ucucuccaggaccaguuuag

SEQ ID NO: 43 - RNA, 20 nt, Artificial Sequence
  antisense sequence
uucucuccaggaccaguuua

SEQ ID NO: 44 - RNA, 20 nt, Artificial Sequence
  antisense sequence
ggacaugcuggcugaggaga

SEQ ID NO: 45 - RNA, 20 nt, Artificial Sequence
  antisense sequence
auggcuuuggcgucucgcuc

SEQ ID NO: 46 - RNA, 20 nt, Artificial Sequence
  antisense sequence
cauggcuuuggcgucucgcu

SEQ ID NO: 47 - RNA, 20 nt, Artificial Sequence
  antisense sequence
accgcauggcuuuggcgucu

SEQ ID NO: 48 - RNA, 20 nt, Artificial Sequence
  antisense sequence
agccguuccucagacucucg

SEQ ID NO: 49 - RNA, 20 nt, Artificial Sequence
  antisense sequence
cguagccguuccucagacuc

SEQ ID NO: 50 - RNA, 20 nt, Artificial Sequence
  antisense sequence
acguagccguuccucagacu

SEQ ID NO: 51 - RNA, 20 nt, Artificial Sequence
  antisense sequence
ucacguagccguuccucaga

SEQ ID NO: 52 - RNA, 20 nt, Artificial Sequence
  antisense sequence
uucacguagccguuccucag

SEQ ID NO: 53 - RNA, 20 nt, Artificial Sequence
  antisense sequence
cuucacguagccguuccuca

SEQ ID NO: 54 - RNA, 20 nt, Artificial Sequence
  antisense sequence
ucuucacguagccguuccuc

SEQ ID NO: 55 - RNA, 20 nt, Artificial Sequence
  antisense sequence
cucuucacguagccguuccu

SEQ ID NO: 56 - RNA, 20 nt, Artificial Sequence
  antisense sequence
gcucuucacguagccguucc

SEQ ID NO: 57 - RNA, 20 nt, Artificial Sequence
  antisense sequence
agcucuucacguagccguuc

SEQ ID NO: 58 - RNA, 20 nt, Artificial Sequence
  antisense sequence
cagcucuucacguagccguu

SEQ ID NO: 59 - RNA, 20 nt, Artificial Sequence
  antisense sequence
gcagcucuucacguagccgu

SEQ ID NO: 60 - RNA, 20 nt, Artificial Sequence
  antisense sequence
acgcagcucuucacguagcc

SEQ ID NO: 61 - RNA, 20 nt, Artificial Sequence
  antisense sequence
cacgcagcucuucacguagc

SEQ ID NO: 62 - RNA, 20 nt, Artificial Sequence
  antisense sequence
ucacgcagcucuucacguag

SEQ ID NO: 63 - RNA, 20 nt, Artificial Sequence
  antisense sequence
cucacgcagcucuucacgua

SEQ ID NO: 64 - RNA, 20 nt, Artificial Sequence
  antisense sequence
gcucacgcagcucuucacgu

SEQ ID NO: 65 - RNA, 20 nt, Artificial Sequence
  antisense sequence
acguugcagaagcggcagag

SEQ ID NO: 66 - RNA, 20 nt, Artificial Sequence
  antisense sequence
cacguugcagaagcggcaga

SEQ ID NO: 67 - RNA, 20 nt, Artificial Sequence
  antisense sequence
uccacguugcagaagcggca

SEQ ID NO: 68 - RNA, 20 nt, Artificial Sequence
  antisense sequence
cagcuccacguugcagaagc

SEQ ID NO: 69 - RNA, 20 nt, Artificial Sequence
  antisense sequence
gcagcuccacguugcagaag

SEQ ID NO: 70 - RNA, 20 nt, Artificial Sequence
  antisense sequence
cgcagcuccacguugcagaa

SEQ ID NO: 71 - RNA, 20 nt, Artificial Sequence
  antisense sequence
agcagcagggcgaggacaaa

SEQ ID NO: 72 - RNA, 20 nt, Artificial Sequence
  antisense sequence
ugcgaacacacgcucagcag

SEQ ID NO: 73 - RNA, 20 nt, Artificial Sequence
  antisense sequence
gugcgaacacacgcucagca

SEQ ID NO: 74 - RNA, 20 nt, Artificial Sequence
  antisense sequence
ggcucaagcugugcgaacac

SEQ ID NO: 75 - RNA, 20 nt, Artificial Sequence
  antisense sequence
gggcucaagcugugcgaaca

SEQ ID NO: 76 - RNA, 20 nt, Artificial Sequence
  antisense sequence
acaggcgaugcugaagaggg

SEQ ID NO: 77 - RNA, 20 nt, Artificial Sequence
  antisense sequence
cacaggcgaugcugaagagg

SEQ ID NO: 78 - RNA, 20 nt, Artificial Sequence
  antisense sequence
gcacaggcgaugcugaagag

SEQ ID NO: 79 - RNA, 20 nt, Artificial Sequence
  antisense sequence
aggcacaggcgaugcugaag

SEQ ID NO: 80 - RNA, 20 nt, Artificial Sequence
  antisense sequence
aaggcacaggcgaugcugaa

SEQ ID NO: 81 - RNA, 20 nt, Artificial Sequence
  antisense sequence
gaaggcacaggcgaugcuga

SEQ ID NO: 82 - RNA, 20 nt, Artificial Sequence
  antisense sequence
agaaggcacaggcgaugcug

SEQ ID NO: 83 - RNA, 20 nt, Artificial Sequence
  antisense sequence
aagaaggcacaggcgaugcu

SEQ ID NO: 84 - RNA, 20 nt, Artificial Sequence
  antisense sequence
agaagaaggcacaggcgaug

SEQ ID NO: 85 - RNA, 20 nt, Artificial Sequence
  antisense sequence
gugaggaagaagaaggcaca

SEQ ID NO: 86 - RNA, 20 nt, Artificial Sequence
  antisense sequence
uugguccgggugaggaagca

SEQ ID NO: 87 - RNA, 20 nt, Artificial Sequence
  antisense sequence
caccacugccacaccaagaa

SEQ ID NO: 88 - RNA, 20 nt, Artificial Sequence
  antisense sequence
gaccaccacugccacaccaa

SEQ ID NO: 89 - RNA, 20 nt, Artificial Sequence
  antisense sequence
aagaccaccacugccacacc

SEQ ID NO: 90 - RNA, 20 nt, Artificial Sequence
  antisense sequence
ucagcaccagcagcaaccug

SEQ ID NO: 91 - RNA, 20 nt, Artificial Sequence
  antisense sequence
gagcagcaccagaacgcagu

SEQ ID NO: 92 - RNA, 20 nt, Artificial Sequence
  antisense sequence
agacccaccagacgaagcug

SEQ ID NO: 93 - RNA, 20 nt, Artificial Sequence
  antisense sequence
gagacccaccagacgaagcu

SEQ ID NO: 94 - RNA, 20 nt, Artificial Sequence
  antisense sequence
ugaaggagacccaccagacg

SEQ ID NO: 95 - RNA, 20 nt, Artificial Sequence
  antisense sequence
gugaaggagacccaccagac

SEQ ID NO: 96 - RNA, 20 nt, Artificial Sequence
  antisense sequence
aggcuggugaaggagaccca

SEQ ID NO: 97 - RNA, 20 nt, Artificial Sequence
  antisense sequence
ugaaagaagugauccaaccc

SEQ ID NO: 98 - RNA, 20 nt, Artificial Sequence
  antisense sequence
uugaaagaagugauccaacc

SEQ ID NO: 99 - RNA, 20 nt, Artificial Sequence
  antisense sequence
ucccugauuugaaagaagug

SEQ ID NO: 100 - RNA, 20 nt, Artificial Sequence
  antisense sequence
cgcuucccugauuugaaaga

SEQ ID NO: 101 - RNA, 20 nt, Artificial Sequence
  antisense sequence
gcgcuucccugauuugaaag

SEQ ID NO: 102 - RNA, 20 nt, Artificial Sequence
  antisense sequence
ggcgcuucccugauuugaaa

SEQ ID NO: 103 - RNA, 20 nt, Artificial Sequence
  antisense sequence
aggcgcuucccugauuugaa

SEQ ID NO: 104 - RNA, 20 nt, Artificial Sequence
  antisense sequence
gaggcgcuucccugauuuga

SEQ ID NO: 105 - RNA, 20 nt, Artificial Sequence
  antisense sequence
agaggcgcuucccugauuug

SEQ ID NO: 106 - RNA, 20 nt, Artificial Sequence
  antisense sequence
aagaggcgcuucccugauuu

SEQ ID NO: 107 - RNA, 20 nt, Artificial Sequence
  antisense sequence
ucgaggaugaagaggcgcuu

SEQ ID NO: 108 - RNA, 20 nt, Artificial Sequence
  antisense sequence
gucgaggaugaagaggcgcu

SEQ ID NO: 109 - RNA, 20 nt, Artificial Sequence
  antisense sequence
agucgaggaugaagaggcgc

SEQ ID NO: 110 - RNA, 20 nt, Artificial Sequence
  antisense sequence
cagucgaggaugaagaggcg

SEQ ID NO: 111 - RNA, 20 nt, Artificial Sequence
  antisense sequence
acagucgaggaugaagaggc

SEQ ID NO: 112 - RNA, 20 nt, Artificial Sequence
  antisense sequence
gacagucgaggaugaagagg

SEQ ID NO: 113 - RNA, 20 nt, Artificial Sequence
  antisense sequence
ggacagucgaggaugaagag

SEQ ID NO: 114 - RNA, 20 nt, Artificial Sequence
  antisense sequence
uggacagucgaggaugaaga

SEQ ID NO: 115 - RNA, 20 nt, Artificial Sequence
  antisense sequence
cuggacagucgaggaugaag

SEQ ID NO: 116 - RNA, 20 nt, Artificial Sequence
  antisense sequence
acuggacagucgaggaugaa

SEQ ID NO: 117 - RNA, 20 nt, Artificial Sequence
  antisense sequence
gcacuggacagucgaggaug

SEQ ID NO: 118 - RNA, 20 nt, Artificial Sequence
  antisense sequence
ggcacuggacagucgaggau

SEQ ID NO: 119 - RNA, 20 nt, Artificial Sequence
  antisense sequence
ggucggaucacaggcacuuu

SEQ ID NO: 120 - RNA, 20 nt, Artificial Sequence
  antisense sequence
gggucggaucacaggcacuu

SEQ ID NO: 121 - RNA, 20 nt, Artificial Sequence
  antisense sequence
ucuccuaacgacacgcagcu

SEQ ID NO: 122 - RNA, 20 nt, Artificial Sequence
  antisense sequence
uucuccuaacgacacgcagc

SEQ ID NO: 123 - RNA, 20 nt, Artificial Sequence
  antisense sequence
uuucuccuaacgacacgcag

SEQ ID NO: 124 - RNA, 20 nt, Artificial Sequence
  antisense sequence
guuucuccuaacgacacgca

SEQ ID NO: 125 - RNA, 20 nt, Artificial Sequence
  antisense sequence
aguuucuccuaacgacacgc

SEQ ID NO: 126 - RNA, 20 nt, Artificial Sequence
  antisense sequence
caguuucuccuaacgacacg

SEQ ID NO: 127 - RNA, 20 nt, Artificial Sequence
  antisense sequence
gcaguuucuccuaacgacac

SEQ ID NO: 128 - RNA, 20 nt, Artificial Sequence
  antisense sequence
ugcaguuucuccuaacgaca

SEQ ID NO: 129 - RNA, 20 nt, Artificial Sequence
  antisense sequence
ugcaacugccauaguaacug

SEQ ID NO: 130 - RNA, 20 nt, Artificial Sequence
  antisense sequence
aacgacggucuccugaauau

SEQ ID NO: 131 - RNA, 20 nt, Artificial Sequence
  antisense sequence
caacgacggucuccugaaua

SEQ ID NO: 132 - RNA, 20 nt, Artificial Sequence
  antisense sequence
gcaacgacggucuccugaau

SEQ ID NO: 133 - RNA, 20 nt, Artificial Sequence
  antisense sequence
ggcaacgacggucuccugaa

SEQ ID NO: 134 - RNA, 20 nt, Artificial Sequence
  antisense sequence
aggcaacgacggucuccuga

SEQ ID NO: 135 - RNA, 20 nt, Artificial Sequence
  antisense sequence
aaggcaacgacggucuccug

SEQ ID NO: 136 - RNA, 20 nt, Artificial Sequence
  antisense sequence
caaggcaacgacggucuccu

SEQ ID NO: 137 - RNA, 20 nt, Artificial Sequence
  antisense sequence
acaaggcaacgacggucucc

SEQ ID NO: 138 - RNA, 20 nt, Artificial Sequence
  antisense sequence
uacaaggcaacgacggucuc

SEQ ID NO: 139 - RNA, 20 nt, Artificial Sequence
  antisense sequence
auacaaggcaacgacggucu

SEQ ID NO: 140 - RNA, 20 nt, Artificial Sequence
  antisense sequence
aauacaaggcaacgacgguc

SEQ ID NO: 141 - RNA, 20 nt, Artificial Sequence
  antisense sequence
aaauacaaggcaacgacggu

SEQ ID NO: 142 - RNA, 20 nt, Artificial Sequence
  antisense sequence
gaaauacaaggcaacgacgg

SEQ ID NO: 143 - RNA, 20 nt, Artificial Sequence
  antisense sequence
cuggaaauacaaggcaacga

SEQ ID NO: 144 - RNA, 20 nt, Artificial Sequence
  antisense sequence
ucuggaaauacaaggcaacg

SEQ ID NO: 145 - RNA, 20 nt, Artificial Sequence
  antisense sequence
cucuggaaauacaaggcaac

SEQ ID NO: 146 - RNA, 20 nt, Artificial Sequence
  antisense sequence
uguucucuggaaauacaagg

SEQ ID NO: 147 - RNA, 20 nt, Artificial Sequence
  antisense sequence
cuguucucuggaaauacaag

SEQ ID NO: 148 - RNA, 20 nt, Artificial Sequence
  antisense sequence
caucuguucucuggaaauac

SEQ ID NO: 149 - RNA, 20 nt, Artificial Sequence
  antisense sequence
gaaucaucuguucucuggaa

SEQ ID NO: 150 - RNA, 20 nt, Artificial Sequence
  antisense sequence
ucccaaagaaucaucuguuc

SEQ ID NO: 151 - RNA, 20 nt, Artificial Sequence
  antisense sequence
cccaaucccaaagaaucauc

SEQ ID NO: 152 - RNA, 20 nt, Artificial Sequence
  antisense sequence
ucccaaucccaaagaaucau

SEQ ID NO: 153 - RNA, 20 nt, Artificial Sequence
  antisense sequence
gucccaaucccaaagaauca

SEQ ID NO: 154 - RNA, 20 nt, Artificial Sequence
  antisense sequence
agucccaaucccaaagaauc

SEQ ID NO: 155 - RNA, 20 nt, Artificial Sequence
  antisense sequence
aagucccaaucccaaagaau

SEQ ID NO: 156 - RNA, 20 nt, Artificial Sequence
  antisense sequence
uaagucccaaucccaaagaa

SEQ ID NO: 157 - RNA, 20 nt, Artificial Sequence
  antisense sequence
uuuaagucccaaucccaaag

SEQ ID NO: 158 - RNA, 20 nt, Artificial Sequence
  antisense sequence
guuuuaagucccaaucccaa

SEQ ID NO: 159 - RNA, 20 nt, Artificial Sequence
  antisense sequence
uguuuuaagucccaauccca

SEQ ID NO: 160 - RNA, 20 nt, Artificial Sequence
  antisense sequence
uuguuuuaagucccaauccc

SEQ ID NO: 161 - RNA, 20 nt, Artificial Sequence
  antisense sequence
uccaccuccagaauuuugau

SEQ ID NO: 162 - RNA, 20 nt, Artificial Sequence
  antisense sequence
uuccaccuccagaauuuuga

SEQ ID NO: 163 - RNA, 20 nt, Artificial Sequence
  antisense sequence
acuccauuuccaccuccaga

SEQ ID NO: 164 - RNA, 20 nt, Artificial Sequence
  antisense sequence
agaucaacuccauuuccacc

SEQ ID NO: 165 - RNA, 20 nt, Artificial Sequence
  antisense sequence
gcacugaaagaucaacucca

SEQ ID NO: 166 - RNA, 20 nt, Artificial Sequence
  antisense sequence
agcacugaaagaucaacucc

SEQ ID NO: 167 - RNA, 20 nt, Artificial Sequence
  antisense sequence
cgagccucauuuagcacuga

SEQ ID NO: 168 - RNA, 20 nt, Artificial Sequence
  antisense sequence
gcgagccucauuuagcacug

SEQ ID NO: 169 - RNA, 20 nt, Artificial Sequence
  antisense sequence
ugcgagccucauuuagcacu

SEQ ID NO: 170 - RNA, 20 nt, Artificial Sequence
  antisense sequence
uugcgagccucauuuagcac

SEQ ID NO: 171 - RNA, 20 nt, Artificial Sequence
  antisense sequence
auugcgagccucauuuagca

SEQ ID NO: 172 - RNA, 20 nt, Artificial Sequence
  antisense sequence
uauugcgagccucauuuagc

SEQ ID NO: 173 - RNA, 20 nt, Artificial Sequence
  antisense sequence
cauauugcgagccucauuua

SEQ ID NO: 174 - RNA, 20 nt, Artificial Sequence
  antisense sequence
ccauauugcgagccucauuu

SEQ ID NO: 175 - RNA, 20 nt, Artificial Sequence
  antisense sequence
accauauugcgagccucauu

SEQ ID NO: 176 - RNA, 20 nt, Artificial Sequence
  antisense sequence
caccauauugcgagccucau

SEQ ID NO: 177 - RNA, 20 nt, Artificial Sequence
  antisense sequence
acaccauauugcgagccuca

SEQ ID NO: 178 - RNA, 20 nt, Artificial Sequence
  antisense sequence
gacaccauauugcgagccuc

SEQ ID NO: 179 - RNA, 20 nt, Artificial Sequence
  antisense sequence
ugacaccauauugcgagccu

SEQ ID NO: 180 - RNA, 20 nt, Artificial Sequence
  antisense sequence
cugacaccauauugcgagcc

SEQ ID NO: 181 - RNA, 20 nt, Artificial Sequence
  antisense sequence
ucugacaccauauugcgagc

SEQ ID NO: 182 - RNA, 20 nt, Artificial Sequence
  antisense sequence
aucugacaccauauugcgag

SEQ ID NO: 183 - RNA, 20 nt, Artificial Sequence
  antisense sequence
gaucugacaccauauugcga

SEQ ID NO: 184 - RNA, 20 nt, Artificial Sequence
  antisense sequence
gcuuggaucagucagaagau

SEQ ID NO: 185 - RNA, 20 nt, Artificial Sequence
  antisense sequence
ggcuuggaucagucagaaga

SEQ ID NO: 186 - RNA, 20 nt, Artificial Sequence
  antisense sequence
aggcuuggaucagucagaag

SEQ ID NO: 187 - RNA, 20 nt, Artificial Sequence
  antisense sequence
aaggcuuggaucagucagaa

SEQ ID NO: 188 - RNA, 20 nt, Artificial Sequence
  antisense sequence
gaaggcuuggaucagucaga

SEQ ID NO: 189 - RNA, 20 nt, Artificial Sequence
  antisense sequence
ggaaggcuuggaucagucag

SEQ ID NO: 190 - RNA, 20 nt, Artificial Sequence
  antisense sequence
uggaaggcuuggaucaguca

SEQ ID NO: 191 - RNA, 20 nt, Artificial Sequence
  antisense sequence
guggaaggcuuggaucaguc

SEQ ID NO: 192 - RNA, 20 nt, Artificial Sequence
  antisense sequence
ugguggaaggcuuggaucag

SEQ ID NO: 193 - RNA, 20 nt, Artificial Sequence
  antisense sequence
gugguggaaggcuuggauca

SEQ ID NO: 194 - RNA, 20 nt, Artificial Sequence
  antisense sequence
ugugguggaaggcuuggauc

SEQ ID NO: 195 - RNA, 20 nt, Artificial Sequence
  antisense sequence
cuugugguggaaggcuugga

SEQ ID NO: 196 - RNA, 20 nt, Artificial Sequence
  antisense sequence
aaaugacuugugguggaagg

SEQ ID NO: 197 - RNA, 20 nt, Artificial Sequence
  antisense sequence
gaaaugacuugugguggaag

SEQ ID NO: 198 - RNA, 20 nt, Artificial Sequence
  antisense sequence
ggaaaugacuugugguggaa

SEQ ID NO: 199 - RNA, 20 nt, Artificial Sequence
  antisense sequence
aggaaaugacuuguggugga

SEQ ID NO: 200 - RNA, 20 nt, Artificial Sequence
  antisense sequence
uagagaggaaaugacuugug

SEQ ID NO: 201 - RNA, 20 nt, Artificial Sequence
  antisense sequence
cuccguagagaggaaaugac

SEQ ID NO: 202 - RNA, 20 nt, Artificial Sequence
  antisense sequence
acuccguagagaggaaauga

SEQ ID NO: 203 - RNA, 20 nt, Artificial Sequence
  antisense sequence
uacuccguagagaggaaaug

SEQ ID NO: 204 - RNA, 20 nt, Artificial Sequence
  antisense sequence
auacuccguagagaggaaau

SEQ ID NO: 205 - RNA, 20 nt, Artificial Sequence
  antisense sequence
aauacuccguagagaggaaa

SEQ ID NO: 206 - RNA, 20 nt, Artificial Sequence
  antisense sequence
uaauacuccguagagaggaa

SEQ ID NO: 207 - RNA, 20 nt, Artificial Sequence
  antisense sequence
cuaauacuccguagagagga

SEQ ID NO: 208 - RNA, 20 nt, Artificial Sequence
  antisense sequence
acuaauacuccguagagagg

SEQ ID NO: 209 - RNA, 20 nt, Artificial Sequence
  antisense sequence
uacuaauacuccguagagag

SEQ ID NO: 210 - RNA, 20 nt, Artificial Sequence
  antisense sequence
agcacccauuaagcuacuaa

SEQ ID NO: 211 - RNA, 20 nt, Artificial Sequence
  antisense sequence
aagcacccauuaagcuacua

SEQ ID NO: 212 - RNA, 20 nt, Artificial Sequence
  antisense sequence
aaagcacccauuaagcuacu

SEQ ID NO: 213 - RNA, 20 nt, Artificial Sequence
  antisense sequence
gaaagcacccauuaagcuac

SEQ ID NO: 214 - RNA, 20 nt, Artificial Sequence
  antisense sequence
agaaagcacccauuaagcua

SEQ ID NO: 215 - RNA, 20 nt, Artificial Sequence
  antisense sequence
gagaaagcacccauuaagcu

SEQ ID NO: 216 - RNA, 20 nt, Artificial Sequence
  antisense sequence
ugagaaagcacccauuaagc

SEQ ID NO: 217 - RNA, 20 nt, Artificial Sequence
  antisense sequence
cugagaaagcacccauuaag

SEQ ID NO: 218 - RNA, 20 nt, Artificial Sequence
  antisense sequence
accugagaaagcacccauua

SEQ ID NO: 219 - RNA, 20 nt, Artificial Sequence
  antisense sequence
aaccugagaaagcacccauu

SEQ ID NO: 220 - RNA, 20 nt, Artificial Sequence
  antisense sequence
gaaccugagaaagcacccau

SEQ ID NO: 221 - RNA, 20 nt, Artificial Sequence
  antisense sequence
ggaaccugagaaagcaccca

SEQ ID NO: 222 - RNA, 20 nt, Artificial Sequence
  antisense sequence
aggaaccugagaaagcaccc

SEQ ID NO: 223 - RNA, 20 nt, Artificial Sequence
  antisense sequence
acaggaaccugagaaagcac

SEQ ID NO: 224 - RNA, 20 nt, Artificial Sequence
  antisense sequence
ucuuuggccuacaggaaccu

SEQ ID NO: 225 - RNA, 20 nt, Artificial Sequence
  antisense sequence
uaaucuuuggccuacaggaa

SEQ ID NO: 226 - RNA, 20 nt, Artificial Sequence
  antisense sequence
uuaaucuuuggccuacagga

SEQ ID NO: 227 - RNA, 20 nt, Artificial Sequence
  antisense sequence
aggaaauggugugagaggau

SEQ ID NO: 228 - RNA, 20 nt, Artificial Sequence
  antisense sequence
ccaggaaauggugugagagg

SEQ ID NO: 229 - RNA, 20 nt, Artificial Sequence
  antisense sequence
uccaggaaauggugugagag

SEQ ID NO: 230 - RNA, 20 nt, Artificial Sequence
  antisense sequence
uccucuauuucagaacaggg

SEQ ID NO: 231 - RNA, 20 nt, Artificial Sequence
  antisense sequence
ggguccucuauuucagaaca

SEQ ID NO: 232 - RNA, 20 nt, Artificial Sequence
  antisense sequence
gcuggguccucuauuucaga

SEQ ID NO: 233 - RNA, 20 nt, Artificial Sequence
  antisense sequence
agcuggguccucuauuucag

SEQ ID NO: 234 - RNA, 20 nt, Artificial Sequence
  antisense sequence
auccugaaguuccugagcuu

SEQ ID NO: 235 - RNA, 20 nt, Artificial Sequence
  antisense sequence
aauccugaaguuccugagcu

SEQ ID NO: 236 - RNA, 20 nt, Artificial Sequence
  antisense sequence
caauccugaaguuccugagc

SEQ ID NO: 237 - RNA, 20 nt, Artificial Sequence
  antisense sequence
gcaauccugaaguuccugag

SEQ ID NO: 238 - RNA, 20 nt, Artificial Sequence
  antisense sequence
guagcaauccugaaguuccu

SEQ ID NO: 239 - RNA, 20 nt, Artificial Sequence
  antisense sequence
guucaacagguagcaauccu

SEQ ID NO: 240 - RNA, 20 nt, Artificial Sequence
  antisense sequence
uguucaacagguagcaaucc

SEQ ID NO: 241 - RNA, 20 nt, Artificial Sequence
  antisense sequence
cgaucccaccuugaagacug

SEQ ID NO: 242 - RNA, 20 nt, Artificial Sequence
  antisense sequence
acgaucccaccuugaagacu

SEQ ID NO: 243 - RNA, 20 nt, Artificial Sequence
  antisense sequence
uacgaucccaccuugaagac

SEQ ID NO: 244 - RNA, 20 nt, Artificial Sequence
  antisense sequence
uuacgaucccaccuugaaga

SEQ ID NO: 245 - RNA, 20 nt, Artificial Sequence
  antisense sequence
auuacgaucccaccuugaag

SEQ ID NO: 246 - RNA, 20 nt, Artificial Sequence
  antisense sequence
uauuacgaucccaccuugaa

SEQ ID NO: 247 - RNA, 20 nt, Artificial Sequence
  antisense sequence
uuauuacgaucccaccuuga

SEQ ID NO: 248 - RNA, 20 nt, Artificial Sequence
  antisense sequence
auuauuacgaucccaccuug

SEQ ID NO: 249 - RNA, 20 nt, Artificial Sequence
  antisense sequence
cauuauuacgaucccaccuu

SEQ ID NO: 250 - RNA, 20 nt, Artificial Sequence
  antisense sequence
ccauuauuacgaucccaccu

SEQ ID NO: 251 - RNA, 20 nt, Artificial Sequence
  antisense sequence
gccauuauuacgaucccacc

SEQ ID NO: 252 - RNA, 20 nt, Artificial Sequence
  antisense sequence
ugccauuauuacgaucccac

SEQ ID NO: 253 - RNA, 20 nt, Artificial Sequence
  antisense sequence
uugccauuauuacgauccca

SEQ ID NO: 254 - RNA, 20 nt, Artificial Sequence
  antisense sequence
uuugccauuauuacgauccc

SEQ ID NO: 255 - RNA, 20 nt, Artificial Sequence
  antisense sequence
ccuugacuugaaaugccaaa

SEQ ID NO: 256 - RNA, 20 nt, Artificial Sequence
  antisense sequence
uccuugacuugaaaugccaa

SEQ ID NO: 257 - RNA, 20 nt, Artificial Sequence
  antisense sequence
auccuugacuugaaaugcca

SEQ ID NO: 258 - RNA, 20 nt, Artificial Sequence
  antisense sequence
cauccuugacuugaaaugcc

SEQ ID NO: 259 - RNA, 20 nt, Artificial Sequence
  antisense sequence
agcauccuugacuugaaaug

SEQ ID NO: 260 - RNA, 20 nt, Artificial Sequence
  antisense sequence
agauagcauccuugacuuga

SEQ ID NO: 261 - RNA, 20 nt, Artificial Sequence
  antisense sequence
uagauagcauccuugacuug

SEQ ID NO: 262 - RNA, 20 nt, Artificial Sequence
  antisense sequence
ccauuuagauagcauccuug

SEQ ID NO: 263 - RNA, 20 nt, Artificial Sequence
  antisense sequence
gcccauuuagauagcauccu

SEQ ID NO: 264 - RNA, 20 nt, Artificial Sequence
  antisense sequence
ggcccauuuagauagcaucc

SEQ ID NO: 265 - RNA, 20 nt, Artificial Sequence
  antisense sequence
aggcccauuuagauagcauc

SEQ ID NO: 266 - RNA, 20 nt, Artificial Sequence
  antisense sequence
gggauagucaguagauuuga

SEQ ID NO: 267 - RNA, 20 nt, Artificial Sequence
  antisense sequence
cgggauagucaguagauuug

SEQ ID NO: 268 - RNA, 20 nt, Artificial Sequence
  antisense sequence
ucgggauagucaguagauuu

SEQ ID NO: 269 - RNA, 20 nt, Artificial Sequence
  antisense sequence
uucgggauagucaguagauu

SEQ ID NO: 270 - RNA, 20 nt, Artificial Sequence
  antisense sequence
ugcuucgggauagucaguag

SEQ ID NO: 271 - RNA, 20 nt, Artificial Sequence
  antisense sequence
uugcuucgggauagucagua

SEQ ID NO: 272 - RNA, 20 nt, Artificial Sequence
  antisense sequence
uuugcuucgggauagucagu

SEQ ID NO: 273 - RNA, 20 nt, Artificial Sequence
  antisense sequence
cuuugcuucgggauagucag

SEQ ID NO: 274 - RNA, 20 nt, Artificial Sequence
  antisense sequence
ccuuugcuucgggauaguca

SEQ ID NO: 275 - RNA, 20 nt, Artificial Sequence
  antisense sequence
accuuugcuucgggauaguc

SEQ ID NO: 276 - RNA, 20 nt, Artificial Sequence
  antisense sequence
gaccuuugcuucgggauagu

SEQ ID NO: 277 - RNA, 20 nt, Artificial Sequence
  antisense sequence
ugaccuuugcuucgggauag

SEQ ID NO: 278 - RNA, 20 nt, Artificial Sequence
  antisense sequence
augaccuuugcuucgggaua

SEQ ID NO: 279 - RNA, 20 nt, Artificial Sequence
  antisense sequence
gaugaccuuugcuucgggau

SEQ ID NO: 280 - RNA, 20 nt, Artificial Sequence
  antisense sequence
agaugaccuuugcuucggga

SEQ ID NO: 281 - RNA, 20 nt, Artificial Sequence
  antisense sequence
aagaugaccuuugcuucggg

SEQ ID NO: 282 - RNA, 20 nt, Artificial Sequence
  antisense sequence
uacagaagaugaccuuugcu

SEQ ID NO: 283 - RNA, 20 nt, Artificial Sequence
  antisense sequence
gauacagaagaugaccuuug

SEQ ID NO: 284 - RNA, 20 nt, Artificial Sequence
  antisense sequence
ucagugauacagaagaugac

SEQ ID NO: 285 - RNA, 20 nt, Artificial Sequence
  antisense sequence
gagucagugauacagaagau

SEQ ID NO: 286 - RNA, 20 nt, Artificial Sequence
  antisense sequence
uggugagucagugauacaga

SEQ ID NO: 287 - RNA, 20 nt, Artificial Sequence
  antisense sequence
cauggugagucagugauaca

SEQ ID NO: 288 - RNA, 20 nt, Artificial Sequence
  antisense sequence
acauggugagucagugauac

SEQ ID NO: 289 - RNA, 20 nt, Artificial Sequence
  antisense sequence
uacauggugagucagugaua

SEQ ID NO: 290 - RNA, 20 nt, Artificial Sequence
  antisense sequence
cuacauggugagucagugau

SEQ ID NO: 291 - RNA, 20 nt, Artificial Sequence
  antisense sequence
ccuacauggugagucaguga

SEQ ID NO: 292 - RNA, 20 nt, Artificial Sequence
  antisense sequence
accuacauggugagucagug

SEQ ID NO: 293 - RNA, 20 nt, Artificial Sequence
  antisense sequence
gaccuacauggugagucagu

SEQ ID NO: 294 - RNA, 20 nt, Artificial Sequence
  antisense sequence
ugagaccuacauggugaguc

SEQ ID NO: 295 - RNA, 20 nt, Artificial Sequence
  antisense sequence
cugagaccuacauggugagu

SEQ ID NO: 296 - RNA, 20 nt, Artificial Sequence
  antisense sequence
ucugagaccuacauggugag

SEQ ID NO: 297 - RNA, 20 nt, Artificial Sequence
  antisense sequence
uucugagaccuacaugguga

SEQ ID NO: 298 - RNA, 20 nt, Artificial Sequence
  antisense sequence
cuucugagaccuacauggug

SEQ ID NO: 299 - RNA, 20 nt, Artificial Sequence
  antisense sequence
ucuucugagaccuacauggu

SEQ ID NO: 300 - RNA, 20 nt, Artificial Sequence
  antisense sequence
cucuucugagaccuacaugg

SEQ ID NO: 301 - RNA, 20 nt, Artificial Sequence
  antisense sequence
gcucuucugagaccuacaug

SEQ ID NO: 302 - RNA, 20 nt, Artificial Sequence
  antisense sequence
agcucuucugagaccuacau

SEQ ID NO: 303 - RNA, 20 nt, Artificial Sequence
  antisense sequence
aacaccagcucuucugagac

SEQ ID NO: 304 - RNA, 20 nt, Artificial Sequence
  antisense sequence
aaacaccagcucuucugaga

SEQ ID NO: 305 - RNA, 20 nt, Artificial Sequence
  antisense sequence
aaaacaccagcucuucugag

SEQ ID NO: 306 - RNA, 20 nt, Artificial Sequence
  antisense sequence
caaaacaccagcucuucuga

SEQ ID NO: 307 - RNA, 20 nt, Artificial Sequence
  antisense sequence
acaaaacaccagcucuucug

SEQ ID NO: 308 - RNA, 20 nt, Artificial Sequence
  antisense sequence
gacaaaacaccagcucuucu

SEQ ID NO: 309 - RNA, 20 nt, Artificial Sequence
  antisense sequence
uggacaaaacaccagcucuu

SEQ ID NO: 310 - RNA, 20 nt, Artificial Sequence
  antisense sequence
ucagacuggacaaaacacca

SEQ ID NO: 311 - RNA, 20 nt, Artificial Sequence
  antisense sequence
cucagacuggacaaaacacc

SEQ ID NO: 312 - RNA, 20 nt, Artificial Sequence
  antisense sequence
acucagacuggacaaaacac

SEQ ID NO: 313 - RNA, 20 nt, Artificial Sequence
  antisense sequence
acaggacucagacuggacaa

SEQ ID NO: 314 - RNA, 20 nt, Artificial Sequence
  antisense sequence
auucacaggacucagacugg

SEQ ID NO: 315 - RNA, 20 nt, Artificial Sequence
  antisense sequence
uuagagagccaguagacacu

SEQ ID NO: 316 - RNA, 20 nt, Artificial Sequence
  antisense sequence
guuagagagccaguagacac

SEQ ID NO: 317 - RNA, 20 nt, Artificial Sequence
  antisense sequence
aguuagagagccaguagaca

SEQ ID NO: 318 - RNA, 20 nt, Artificial Sequence
  antisense sequence
uaguuagagagccaguagac

SEQ ID NO: 319 - RNA, 20 nt, Artificial Sequence
  antisense sequence
uuaguuagagagccaguaga

SEQ ID NO: 320 - RNA, 20 nt, Artificial Sequence
  antisense sequence
auuaguuagagagccaguag

SEQ ID NO: 321 - RNA, 20 nt, Artificial Sequence
  antisense sequence
cgauuaguuagagagccagu

SEQ ID NO: 322 - RNA, 20 nt, Artificial Sequence
  antisense sequence
ucgauuaguuagagagccag

SEQ ID NO: 323 - RNA, 20 nt, Artificial Sequence
  antisense sequence
gaaauucuaugggugaucga

SEQ ID NO: 324 - RNA, 20 nt, Artificial Sequence
  antisense sequence
ggaaauucuaugggugaucg

SEQ ID NO: 325 - RNA, 20 nt, Artificial Sequence
  antisense sequence
caggaaauucuaugggugau

SEQ ID NO: 326 - RNA, 20 nt, Artificial Sequence
  antisense sequence
ucaggaaauucuauggguga

SEQ ID NO: 327 - RNA, 20 nt, Artificial Sequence
  antisense sequence
aucaggaaauucuaugggug

SEQ ID NO: 328 - RNA, 20 nt, Artificial Sequence
  antisense sequence
guaucaggaaauucuauggg

SEQ ID NO: 329 - RNA, 20 nt, Artificial Sequence
  antisense sequence
cagcaguaucaggaaauucu

SEQ ID NO: 330 - RNA, 20 nt, Artificial Sequence
  antisense sequence
ucagcaguaucaggaaauuc

SEQ ID NO: 331 - RNA, 20 nt, Artificial Sequence
  antisense sequence
aggugcauugcccagagauc

SEQ ID NO: 332 - RNA, 20 nt, Artificial Sequence
  antisense sequence
uaggugcauugcccagagau

SEQ ID NO: 333 - RNA, 20 nt, Artificial Sequence
  antisense sequence
uuaggugcauugcccagaga

SEQ ID NO: 334 - RNA, 20 nt, Artificial Sequence
  antisense sequence
gaguauuaggugcauugccc

SEQ ID NO: 335 - RNA, 20 nt, Artificial Sequence
  antisense sequence
ggaguauuaggugcauugcc

SEQ ID NO: 336 - RNA, 20 nt, Artificial Sequence
  antisense sequence
uggaguauuaggugcauugc

SEQ ID NO: 337 - RNA, 20 nt, Artificial Sequence
  antisense sequence
cuggaguauuaggugcauug

SEQ ID NO: 338 - RNA, 20 nt, Artificial Sequence
  antisense sequence
ucuggaguauuaggugcauu

SEQ ID NO: 339 - RNA, 20 nt, Artificial Sequence
  antisense sequence
aucuggaguauuaggugcau

SEQ ID NO: 340 - RNA, 20 nt, Artificial Sequence
  antisense sequence
aaucuggaguauuaggugca

SEQ ID NO: 341 - RNA, 20 nt, Artificial Sequence
  antisense sequence
guuacacagauugcuaucag

SEQ ID NO: 342 - RNA, 20 nt, Artificial Sequence
  antisense sequence
agcauuugauguccacagcu

SEQ ID NO: 343 - RNA, 20 nt, Artificial Sequence
  antisense sequence
uucaccugauuuuccacugc

SEQ ID NO: 344 - RNA, 20 nt, Artificial Sequence
  antisense sequence
cuucaccugauuuuccacug

SEQ ID NO: 345 - RNA, 20 nt, Artificial Sequence
  antisense sequence
ucuucaccugauuuuccacu

SEQ ID NO: 346 - RNA, 20 nt, Artificial Sequence
  antisense sequence
uucuucaccugauuuuccac

SEQ ID NO: 347 - RNA, 20 nt, Artificial Sequence
  antisense sequence
cuucuucaccugauuuucca

SEQ ID NO: 348 - RNA, 20 nt, Artificial Sequence
  antisense sequence
ucuucuucaccugauuuucc

SEQ ID NO: 349 - RNA, 20 nt, Artificial Sequence
  antisense sequence
ccacuuaucaccuuccugaa

SEQ ID NO: 350 - RNA, 20 nt, Artificial Sequence
  antisense sequence
gccacuuaucaccuuccuga

SEQ ID NO: 351 - RNA, 20 nt, Artificial Sequence
  antisense sequence
agccacuuaucaccuuccug

SEQ ID NO: 352 - RNA, 20 nt, Artificial Sequence
  antisense sequence
uagccacuuaucaccuuccu

SEQ ID NO: 353 - RNA, 20 nt, Artificial Sequence
  antisense sequence
uuagccacuuaucaccuucc

SEQ ID NO: 354 - RNA, 20 nt, Artificial Sequence
  antisense sequence
guuagccacuuaucaccuuc

SEQ ID NO: 355 - RNA, 20 nt, Artificial Sequence
  antisense sequence
uguuagccacuuaucaccuu

SEQ ID NO: 356 - RNA, 20 nt, Artificial Sequence
  antisense sequence
cuguuagccacuuaucaccu

SEQ ID NO: 357 - RNA, 20 nt, Artificial Sequence
  antisense sequence
ucuguuagccacuuaucacc

SEQ ID NO: 358 - RNA, 20 nt, Artificial Sequence
  antisense sequence
uucuguuagccacuuaucac

SEQ ID NO: 359 - RNA, 20 nt, Artificial Sequence
  antisense sequence
cuucuguuagccacuuauca

SEQ ID NO: 360 - RNA, 20 nt, Artificial Sequence
  antisense sequence
ucuucuguuagccacuuauc

SEQ ID NO: 361 - RNA, 20 nt, Artificial Sequence
  antisense sequence
ccucuucuguuagccacuua

SEQ ID NO: 362 - RNA, 20 nt, Artificial Sequence
  antisense sequence
gccucuucuguuagccacuu

SEQ ID NO: 363 - RNA, 20 nt, Artificial Sequence
  antisense sequence
ugccucuucuguuagccacu

SEQ ID NO: 364 - RNA, 20 nt, Artificial Sequence
  antisense sequence
gugccucuucuguuagccac

SEQ ID NO: 365 - RNA, 20 nt, Artificial Sequence
  antisense sequence
guucacucugugccucuucu

SEQ ID NO: 366 - RNA, 20 nt, Artificial Sequence
  antisense sequence
uguucacucugugccucuuc

SEQ ID NO: 367 - RNA, 20 nt, Artificial Sequence
  antisense sequence
gcuguucacucugugccucu

SEQ ID NO: 368 - RNA, 20 nt, Artificial Sequence
  antisense sequence
ugcuguucacucugugccuc

SEQ ID NO: 369 - RNA, 20 nt, Artificial Sequence
  antisense sequence
uugcuguucacucugugccu

SEQ ID NO: 370 - RNA, 20 nt, Artificial Sequence
  antisense sequence
uuugcuguucacucugugcc

SEQ ID NO: 371 - RNA, 20 nt, Artificial Sequence
  antisense sequence
guuugcuguucacucugugc

SEQ ID NO: 372 - RNA, 20 nt, Artificial Sequence
  antisense sequence
uguuugcuguucacucugug

SEQ ID NO: 373 - RNA, 20 nt, Artificial Sequence
  antisense sequence
uuguuugcuguucacucugu

SEQ ID NO: 374 - RNA, 20 nt, Artificial Sequence
  antisense sequence
uuuguuugcuguucacucug

SEQ ID NO: 375 - RNA, 20 nt, Artificial Sequence
  antisense sequence
gguccagugauacuuccugu

SEQ ID NO: 376 - RNA, 20 nt, Artificial Sequence
  antisense sequence
agguccagugauacuuccug

SEQ ID NO: 377 - RNA, 20 nt, Artificial Sequence
  antisense sequence
ucagguccagugauacuucc

SEQ ID NO: 378 - RNA, 20 nt, Artificial Sequence
  antisense sequence
acuaaaaucagguccaguga

SEQ ID NO: 379 - RNA, 20 nt, Artificial Sequence
  antisense sequence
uacuaaaaucagguccagug

SEQ ID NO: 380 - RNA, 20 nt, Artificial Sequence
  antisense sequence
ucuacuaaaaucagguccag

SEQ ID NO: 381 - RNA, 20 nt, Artificial Sequence
  antisense sequence
cuucuacuaaaaucaggucc

SEQ ID NO: 382 - RNA, 20 nt, Artificial Sequence
  antisense sequence
ccaguugcucaucuuuucua

SEQ ID NO: 383 - RNA, 20 nt, Artificial Sequence
  antisense sequence
cccaucuuuucuacaaguuc

SEQ ID NO: 384 - RNA, 20 nt, Artificial Sequence
  antisense sequence
cuuccugauuucucucccau

SEQ ID NO: 385 - RNA, 20 nt, Artificial Sequence
  antisense sequence
gacugagaauccuuccugau

SEQ ID NO: 386 - RNA, 20 nt, Artificial Sequence
  antisense sequence
cugacugagaauccuuccug

SEQ ID NO: 387 - RNA, 20 nt, Artificial Sequence
  antisense sequence
uaaccugacugagaauccuu

SEQ ID NO: 388 - RNA, 20 nt, Artificial Sequence
  antisense sequence
auaaccugacugagaauccu

SEQ ID NO: 389 - RNA, 20 nt, Artificial Sequence
  antisense sequence
cauaaccugacugagaaucc

SEQ ID NO: 390 - RNA, 20 nt, Artificial Sequence
  antisense sequence
acauaaccugacugagaauc

SEQ ID NO: 391 - RNA, 20 nt, Artificial Sequence
  antisense sequence
ccaauaaaccagugucuuga

SEQ ID NO: 392 - RNA, 20 nt, Artificial Sequence
  antisense sequence
gucucgauagccauuuucua

SEQ ID NO: 393 - RNA, 20 nt, Artificial Sequence
  antisense sequence
ugucucgauagccauuuucu

SEQ ID NO: 394 - RNA, 20 nt, Artificial Sequence
  antisense sequence
augucucgauagccauuuuc

SEQ ID NO: 395 - RNA, 20 nt, Artificial Sequence
  antisense sequence
aggaaugucucgauagccau

SEQ ID NO: 396 - RNA, 20 nt, Artificial Sequence
  antisense sequence
aaggaaugucucgauagcca

SEQ ID NO: 397 - RNA, 20 nt, Artificial Sequence
  antisense sequence
uaaggaaugucucgauagcc

SEQ ID NO: 398 - RNA, 20 nt, Artificial Sequence
  antisense sequence
auaaggaaugucucgauagc

SEQ ID NO: 399 - RNA, 20 nt, Artificial Sequence
  antisense sequence
gauaaggaaugucucgauag

SEQ ID NO: 400 - RNA, 20 nt, Artificial Sequence
  antisense sequence
gugauaaggaaugucucgau

SEQ ID NO: 401 - RNA, 20 nt, Artificial Sequence
  antisense sequence
ugugauaaggaaugucucga

SEQ ID NO: 402 - RNA, 20 nt, Artificial Sequence
  antisense sequence
uugugauaaggaaugucucg

SEQ ID NO: 403 - RNA, 20 nt, Artificial Sequence
  antisense sequence
cgauugugauaaggaauguc

SEQ ID NO: 404 - RNA, 20 nt, Artificial Sequence
  antisense sequence
uguagcacaucuguggcaug

SEQ ID NO: 405 - RNA, 20 nt, Artificial Sequence
  antisense sequence
accaaacugcauguagcaca

SEQ ID NO: 406 - RNA, 20 nt, Artificial Sequence
  antisense sequence
ucagauaccaaacugcaugu

SEQ ID NO: 407 - RNA, 20 nt, Artificial Sequence
  antisense sequence
gucagauaccaaacugcaug

SEQ ID NO: 408 - RNA, 20 nt, Artificial Sequence
  antisense sequence
uugucagauaccaaacugca

SEQ ID NO: 409 - RNA, 20 nt, Artificial Sequence
  antisense sequence
guugucagauaccaaacugc

SEQ ID NO: 410 - RNA, 20 nt, Artificial Sequence
  antisense sequence
uguugucagauaccaaacug

SEQ ID NO: 411 - RNA, 20 nt, Artificial Sequence
  antisense sequence
guguugucagauaccaaacu

SEQ ID NO: 412 - RNA, 20 nt, Artificial Sequence
  antisense sequence
cguguugucagauaccaaac

SEQ ID NO: 413 - RNA, 20 nt, Artificial Sequence
  antisense sequence
ccguguugucagauaccaaa

SEQ ID NO: 414 - RNA, 20 nt, Artificial Sequence
  antisense sequence
ggccguguugucagauacca

SEQ ID NO: 415 - RNA, 20 nt, Artificial Sequence
  antisense sequence
uggccguguugucagauacc

SEQ ID NO: 416 - RNA, 20 nt, Artificial Sequence
  antisense sequence
cuggccguguugucagauac

SEQ ID NO: 417 - RNA, 20 nt, Artificial Sequence
  antisense sequence
acuggccguguugucagaua

SEQ ID NO: 418 - RNA, 20 nt, Artificial Sequence
  antisense sequence
aacuggccguguugucagau

SEQ ID NO: 419 - RNA, 20 nt, Artificial Sequence
  antisense sequence
gaacuggccguguugucaga

SEQ ID NO: 420 - RNA, 20 nt, Artificial Sequence
  antisense sequence
aggaacuggccguguuguca

SEQ ID NO: 421 - RNA, 20 nt, Artificial Sequence
  antisense sequence
caggaacuggccguguuguc

SEQ ID NO: 422 - RNA, 20 nt, Artificial Sequence
  antisense sequence
cugcuguaagccaggaacug

SEQ ID NO: 423 - RNA, 20 nt, Artificial Sequence
  antisense sequence
ucugcuguaagccaggaacu

SEQ ID NO: 424 - RNA, 20 nt, Artificial Sequence
  antisense sequence
aucugcuguaagccaggaac

SEQ ID NO: 425 - RNA, 20 nt, Artificial Sequence
  antisense sequence
gaucugcuguaagccaggaa

SEQ ID NO: 426 - RNA, 20 nt, Artificial Sequence
  antisense sequence
ggaucugcuguaagccagga

SEQ ID NO: 427 - RNA, 20 nt, Artificial Sequence
  antisense sequence
uggaucugcuguaagccagg

SEQ ID NO: 428 - RNA, 20 nt, Artificial Sequence
  antisense sequence
guggaucugcuguaagccag

SEQ ID NO: 429 - RNA, 20 nt, Artificial Sequence
  antisense sequence
uguggaucugcuguaagcca

SEQ ID NO: 430 - RNA, 20 nt, Artificial Sequence
  antisense sequence
uuguggaucugcuguaagcc

SEQ ID NO: 431 - RNA, 20 nt, Artificial Sequence
  antisense sequence
auuguggaucugcuguaagc

SEQ ID NO: 432 - RNA, 20 nt, Artificial Sequence
  antisense sequence
cauuguggaucugcuguaag

SEQ ID NO: 433 - RNA, 20 nt, Artificial Sequence
  antisense sequence
cuaccaucagaaucuguuuc

SEQ ID NO: 434 - RNA, 20 nt, Artificial Sequence
  antisense sequence
auauaagcaauucgcccaug

SEQ ID NO: 435 - RNA, 20 nt, Artificial Sequence
  antisense sequence
gaaauauaagcaauucgccc

SEQ ID NO: 436 - RNA, 20 nt, Artificial Sequence
  antisense sequence
cucaucaggauuagagcagc

SEQ ID NO: 437 - RNA, 20 nt, Artificial Sequence
  antisense sequence
gccauaacucucaucaggau

SEQ ID NO: 438 - RNA, 20 nt, Artificial Sequence
  antisense sequence
agccauaacucucaucagga

SEQ ID NO: 439 - RNA, 20 nt, Artificial Sequence
  antisense sequence
cagccauaacucucaucagg

SEQ ID NO: 440 - RNA, 20 nt, Artificial Sequence
  antisense sequence
gcagccauaacucucaucag

SEQ ID NO: 441 - RNA, 20 nt, Artificial Sequence
  antisense sequence
ggcagccauaacucucauca

SEQ ID NO: 442 - RNA, 20 nt, Artificial Sequence
  antisense sequence
aggcagccauaacucucauc

SEQ ID NO: 443 - RNA, 20 nt, Artificial Sequence
  antisense sequence
caggcagccauaacucucau

SEQ ID NO: 444 - RNA, 20 nt, Artificial Sequence
  antisense sequence
acaggcagccauaacucuca

SEQ ID NO: 445 - RNA, 20 nt, Artificial Sequence
  antisense sequence
gacaggcagccauaacucuc

SEQ ID NO: 446 - RNA, 20 nt, Artificial Sequence
  antisense sequence
aagacaggcagccauaacuc

SEQ ID NO: 447 - RNA, 20 nt, Artificial Sequence
  antisense sequence
ugaagacaggcagccauaac

SEQ ID NO: 448 - RNA, 20 nt, Artificial Sequence
  antisense sequence
gcaggaauguuugaagacag

SEQ ID NO: 449 - RNA, 20 nt, Artificial Sequence
  antisense sequence
ugcaggaauguuugaagaca

SEQ ID NO: 450 - RNA, 20 nt, Artificial Sequence
  antisense sequence
agagccaucaauucuaaugc

SEQ ID NO: 451 - RNA, 20 nt, Artificial Sequence
  antisense sequence
cguauagagccaucaauucu

SEQ ID NO: 452 - RNA, 20 nt, Artificial Sequence
  antisense sequence
cacguauagagccaucaauu

SEQ ID NO: 453 - RNA, 20 nt, Artificial Sequence
  antisense sequence
ccacguauagagccaucaau

SEQ ID NO: 454 - RNA, 20 nt, Artificial Sequence
  antisense sequence
gccacguauagagccaucaa

SEQ ID NO: 455 - RNA, 20 nt, Artificial Sequence
  antisense sequence
ugccacguauagagccauca

SEQ ID NO: 456 - RNA, 20 nt, Artificial Sequence
  antisense sequence
gcugccacguauagagccau

SEQ ID NO: 457 - RNA, 20 nt, Artificial Sequence
  antisense sequence
agcugccacguauagagcca

SEQ ID NO: 458 - RNA, 20 nt, Artificial Sequence
  antisense sequence
ugcauuuguccucccugggu

SEQ ID NO: 459 - RNA, 20 nt, Artificial Sequence
  antisense sequence
uguauaaaacugccugaggg

SEQ ID NO: 460 - RNA, 20 nt, Artificial Sequence
  antisense sequence
uuguauaaaacugccugagg

SEQ ID NO: 461 - RNA, 20 nt, Artificial Sequence
  antisense sequence
gcaugaugauuuuccagaac

SEQ ID NO: 462 - RNA, 20 nt, Artificial Sequence
  antisense sequence
ugacgcagcaugaugauuuu

SEQ ID NO: 463 - RNA, 20 nt, Artificial Sequence
  antisense sequence
uagauuccaagcugacgcag

SEQ ID NO: 464 - RNA, 20 nt, Artificial Sequence
  antisense sequence
auagauuccaagcugacgca

SEQ ID NO: 465 - RNA, 20 nt, Artificial Sequence
  antisense sequence
uauagauuccaagcugacgc

SEQ ID NO: 466 - RNA, 20 nt, Artificial Sequence
  antisense sequence
auauagauuccaagcugacg

SEQ ID NO: 467 - RNA, 20 nt, Artificial Sequence
  antisense sequence
gauauagauuccaagcugac

SEQ ID NO: 468 - RNA, 20 nt, Artificial Sequence
  antisense sequence
gcgagaaagauauagauucc

SEQ ID NO: 469 - RNA, 20 nt, Artificial Sequence
  antisense sequence
ggcgagaaagauauagauuc

SEQ ID NO: 470 - RNA, 20 nt, Artificial Sequence
  antisense sequence
ugggcgagaaagauauagau

SEQ ID NO: 471 - RNA, 20 nt, Artificial Sequence
  antisense sequence
cugggcgagaaagauauaga

SEQ ID NO: 472 - RNA, 20 nt, Artificial Sequence
  antisense sequence
ucugggcgagaaagauauag

SEQ ID NO: 473 - RNA, 20 nt, Artificial Sequence
  antisense sequence
aaguuguauucugggcgaga

SEQ ID NO: 474 - RNA, 20 nt, Artificial Sequence
  antisense sequence
gaaguuguauucugggcgag

SEQ ID NO: 475 - RNA, 20 nt, Artificial Sequence
  antisense sequence
aaggaaguuguauucugggc

SEQ ID NO: 476 - RNA, 20 nt, Artificial Sequence
  antisense sequence
uuuaagauccguagcaagga

SEQ ID NO: 477 - RNA, 20 nt, Artificial Sequence
  antisense sequence
uuuuaagauccguagcaagg

SEQ ID NO: 478 - RNA, 20 nt, Artificial Sequence
  antisense sequence
cugcgagaaaaucaaaaugc

SEQ ID NO: 479 - RNA, 20 nt, Artificial Sequence
  antisense sequence
ucauuacuccauucuaugcc

SEQ ID NO: 480 - RNA, 20 nt, Artificial Sequence
  antisense sequence
ggcgaucauuuucauuacuc

SEQ ID NO: 481 - RNA, 20 nt, Artificial Sequence
  antisense sequence
gaggcgaucauuuucauuac

SEQ ID NO: 482 - RNA, 20 nt, Artificial Sequence
  antisense sequence
caagaggcgaucauuuucau

SEQ ID NO: 483 - RNA, 20 nt, Artificial Sequence
  antisense sequence
ccaagaggcgaucauuuuca

SEQ ID NO: 484 - RNA, 20 nt, Artificial Sequence
  antisense sequence
accaagaggcgaucauuuuc

SEQ ID NO: 485 - RNA, 20 nt, Artificial Sequence
  antisense sequence
uaccaagaggcgaucauuuu

SEQ ID NO: 486 - RNA, 20 nt, Artificial Sequence
  antisense sequence
auaccaagaggcgaucauuu

SEQ ID NO: 487 - RNA, 20 nt, Artificial Sequence
  antisense sequence
cauaccaagaggcgaucauu

SEQ ID NO: 488 - RNA, 20 nt, Artificial Sequence
  antisense sequence
gcauaccaagaggcgaucau

SEQ ID NO: 489 - RNA, 20 nt, Artificial Sequence
  antisense sequence
ggcauaccaagaggcgauca

SEQ ID NO: 490 - RNA, 20 nt, Artificial Sequence
  antisense sequence
uggcauaccaagaggcgauc

SEQ ID NO: 491 - RNA, 20 nt, Artificial Sequence
  antisense sequence
cuggcauaccaagaggcgau

SEQ ID NO: 492 - RNA, 20 nt, Artificial Sequence
  antisense sequence
ccuggcauaccaagaggcga

SEQ ID NO: 493 - RNA, 20 nt, Artificial Sequence
  antisense sequence
accuggcauaccaagaggcg

SEQ ID NO: 494 - RNA, 20 nt, Artificial Sequence
  antisense sequence
caccuggcauaccaagaggc

SEQ ID NO: 495 - RNA, 20 nt, Artificial Sequence
  antisense sequence
acaccuggcauaccaagagg

SEQ ID NO: 496 - RNA, 20 nt, Artificial Sequence
  antisense sequence
cacaccuggcauaccaagag

SEQ ID NO: 497 - RNA, 20 nt, Artificial Sequence
  antisense sequence
gcacaccuggcauaccaaga

SEQ ID NO: 498 - RNA, 20 nt, Artificial Sequence
  antisense sequence
aguuugaugcacaccuggca

SEQ ID NO: 499 - RNA, 20 nt, Artificial Sequence
  antisense sequence
caguuugaugcacaccuggc

SEQ ID NO: 500 - RNA, 20 nt, Artificial Sequence
  antisense sequence
gccaguuugaugcacaccug

SEQ ID NO: 501 - RNA, 20 nt, Artificial Sequence
  antisense sequence
ugccaguuugaugcacaccu

SEQ ID NO: 502 - RNA, 20 nt, Artificial Sequence
  antisense sequence
aucugccaguuugaugcaca

SEQ ID NO: 503 - RNA, 20 nt, Artificial Sequence
  antisense sequence
uaucugccaguuugaugcac

SEQ ID NO: 504 - RNA, 20 nt, Artificial Sequence
  antisense sequence
auaucugccaguuugaugca

SEQ ID NO: 505 - RNA, 20 nt, Artificial Sequence
  antisense sequence
ggccauuuauaucugccagu

SEQ ID NO: 506 - RNA, 20 nt, Artificial Sequence
  antisense sequence
gggccauuuauaucugccag

SEQ ID NO: 507 - RNA, 20 nt, Artificial Sequence
  antisense sequence
ugggccauuuauaucugcca

SEQ ID NO: 508 - RNA, 20 nt, Artificial Sequence
  antisense sequence
cugggccauuuauaucugcc

SEQ ID NO: 509 - RNA, 20 nt, Artificial Sequence
  antisense sequence
ugcugggccauuuauaucug

SEQ ID NO: 510 - RNA, 20 nt, Artificial Sequence
  antisense sequence
uugcugggccauuuauaucu

SEQ ID NO: 511 - RNA, 20 nt, Artificial Sequence
  antisense sequence
uuugcugggccauuuauauc

SEQ ID NO: 512 - RNA, 20 nt, Artificial Sequence
  antisense sequence
ucgaacuuuugcugggccau

SEQ ID NO: 513 - RNA, 20 nt, Artificial Sequence
  antisense sequence
cucgaacuuuugcugggcca

SEQ ID NO: 514 - RNA, 20 nt, Artificial Sequence
  antisense sequence
ucucgaacuuuugcugggcc

SEQ ID NO: 515 - RNA, 20 nt, Artificial Sequence
  antisense sequence
gucucgaacuuuugcugggc

SEQ ID NO: 516 - RNA, 20 nt, Artificial Sequence
  antisense sequence
agucucgaacuuuugcuggg

SEQ ID NO: 517 - RNA, 20 nt, Artificial Sequence
  antisense sequence
ucaaaugcaagucucgaacu

SEQ ID NO: 518 - RNA, 20 nt, Artificial Sequence
  antisense sequence
augccuucuguccauuucaa

SEQ ID NO: 519 - RNA, 20 nt, Artificial Sequence
  antisense sequence
ucucccugcucauaaaauuc

SEQ ID NO: 520 - RNA, 20 nt, Artificial Sequence
  antisense sequence
caucucccugcucauaaaau

SEQ ID NO: 521 - RNA, 20 nt, Artificial Sequence
  antisense sequence
ugcuucuucaucucccugcu

SEQ ID NO: 522 - RNA, 20 nt, Artificial Sequence
  antisense sequence
gcagaccaagauuugcuucu

SEQ ID NO: 523 - RNA, 20 nt, Artificial Sequence
  antisense sequence
ggcagaccaagauuugcuuc

SEQ ID NO: 524 - RNA, 20 nt, Artificial Sequence
  antisense sequence
gggcagaccaagauuugcuu

SEQ ID NO: 525 - RNA, 20 nt, Artificial Sequence
  antisense sequence
ugggcagaccaagauuugcu

SEQ ID NO: 526 - RNA, 20 nt, Artificial Sequence
  antisense sequence
augggcagaccaagauuugc

SEQ ID NO: 527 - RNA, 20 nt, Artificial Sequence
  antisense sequence
gaugggcagaccaagauuug

SEQ ID NO: 528 - RNA, 20 nt, Artificial Sequence
  antisense sequence
cugaugggcagaccaagauu

SEQ ID NO: 529 - RNA, 20 nt, Artificial Sequence
  antisense sequence
acugaugggcagaccaagau

SEQ ID NO: 530 - RNA, 20 nt, Artificial Sequence
  antisense sequence
gacugaugggcagaccaaga

SEQ ID NO: 531 - RNA, 20 nt, Artificial Sequence
  antisense sequence
aauggacugaugggcagacc

SEQ ID NO: 532 - RNA, 20 nt, Artificial Sequence
  antisense sequence
ugaauggacugaugggcaga

SEQ ID NO: 533 - RNA, 20 nt, Artificial Sequence
  antisense sequence
caugaauggacugaugggca

SEQ ID NO: 534 - RNA, 20 nt, Artificial Sequence
  antisense sequence
gaagaacgauccaugaaugg

SEQ ID NO: 535 - RNA, 20 nt, Artificial Sequence
  antisense sequence
agaagaacgauccaugaaug

SEQ ID NO: 536 - RNA, 20 nt, Artificial Sequence
  antisense sequence
gagaagaacgauccaugaau

SEQ ID NO: 537 - RNA, 20 nt, Artificial Sequence
  antisense sequence
ggagaagaacgauccaugaa

SEQ ID NO: 538 - RNA, 20 nt, Artificial Sequence
  antisense sequence
aggagaagaacgauccauga

SEQ ID NO: 539 - RNA, 20 nt, Artificial Sequence
  antisense sequence
gaggagaagaacgauccaug

SEQ ID NO: 540 - RNA, 20 nt, Artificial Sequence
  antisense sequence
ugaggagaagaacgauccau

SEQ ID NO: 541 - RNA, 20 nt, Artificial Sequence
  antisense sequence
uugaggagaagaacgaucca

SEQ ID NO: 542 - RNA, 20 nt, Artificial Sequence
  antisense sequence
guugaggagaagaacgaucc

SEQ ID NO: 543 - RNA, 20 nt, Artificial Sequence
  antisense sequence
aguugaggagaagaacgauc

SEQ ID NO: 544 - RNA, 20 nt, Artificial Sequence
  antisense sequence
uaguugaggagaagaacgau

SEQ ID NO: 545 - RNA, 20 nt, Artificial Sequence
  antisense sequence
cuaguugaggagaagaacga

SEQ ID NO: 546 - RNA, 20 nt, Artificial Sequence
  antisense sequence
gcuaguugaggagaagaacg

SEQ ID NO: 547 - RNA, 20 nt, Artificial Sequence
  antisense sequence
ugcuaguugaggagaagaac

SEQ ID NO: 548 - RNA, 20 nt, Artificial Sequence
  antisense sequence
uugcuaguugaggagaagaa

SEQ ID NO: 549 - RNA, 20 nt, Artificial Sequence
  antisense sequence
uuugcuaguugaggagaaga

SEQ ID NO: 550 - RNA, 20 nt, Artificial Sequence
  antisense sequence
uuuugcuaguugaggagaag

SEQ ID NO: 551 - RNA, 20 nt, Artificial Sequence
  antisense sequence
guuuugcuaguugaggagaa

SEQ ID NO: 552 - RNA, 20 nt, Artificial Sequence
  antisense sequence
aguuuugcuaguugaggaga

SEQ ID NO: 553 - RNA, 20 nt, Artificial Sequence
  antisense sequence
gaguuuugcuaguugaggag

SEQ ID NO: 554 - RNA, 20 nt, Artificial Sequence
  antisense sequence
uggaguuuugcuaguugagg

SEQ ID NO: 555 - RNA, 20 nt, Artificial Sequence
  antisense sequence
cuuggaguuuugcuaguuga

SEQ ID NO: 556 - RNA, 20 nt, Artificial Sequence
  antisense sequence
ucuuggaguuuugcuaguug

SEQ ID NO: 557 - RNA, 20 nt, Artificial Sequence
  antisense sequence
gauucuuggaguuuugcuag

SEQ ID NO: 558 - RNA, 20 nt, Artificial Sequence
  antisense sequence
gggugauaaaagauucuugg

SEQ ID NO: 559 - RNA, 20 nt, Artificial Sequence
  antisense sequence
cacuaugugggugauaaaag

SEQ ID NO: 560 - RNA, 20 nt, Artificial Sequence
  antisense sequence
aucauaggaguuacacaggg

SEQ ID NO: 561 - RNA, 20 nt, Artificial Sequence
  antisense sequence
gcaucauaggaguuacacag

SEQ ID NO: 562 - RNA, 20 nt, Artificial Sequence
  antisense sequence
cagcaucauaggaguuacac

SEQ ID NO: 563 - RNA, 20 nt, Artificial Sequence
  antisense sequence
gcagcaucauaggaguuaca

SEQ ID NO: 564 - RNA, 20 nt, Artificial Sequence
  antisense sequence
ccagcagcaucauaggaguu

SEQ ID NO: 565 - RNA, 20 nt, Artificial Sequence
  antisense sequence
accagcagcaucauaggagu

SEQ ID NO: 566 - RNA, 20 nt, Artificial Sequence
  antisense sequence
gcaaaccagcagcaucauag

SEQ ID NO: 567 - RNA, 20 nt, Artificial Sequence
  antisense sequence
cacugaccugguagcaaacc

SEQ ID NO: 568 - RNA, 20 nt, Artificial Sequence
  antisense sequence
caucaccacuuucaguauca

SEQ ID NO: 569 - RNA, 20 nt, Artificial Sequence
  antisense sequence
ucaucaccacuuucaguauc

SEQ ID NO: 570 - RNA, 20 nt, Artificial Sequence
  antisense sequence
ucaucaucaccacuuucagu

SEQ ID NO: 571 - RNA, 20 nt, Artificial Sequence
  antisense sequence
cgucuucaucaucaccacuu

SEQ ID NO: 572 - RNA, 20 nt, Artificial Sequence
  antisense sequence
auucuucaccgucuucauca

SEQ ID NO: 573 - RNA, 20 nt, Artificial Sequence
  antisense sequence
aauucuucaccgucuucauc

SEQ ID NO: 574 - RNA, 20 nt, Artificial Sequence
  antisense sequence
cuaauucuucaccgucuuca

SEQ ID NO: 575 - RNA, 20 nt, Artificial Sequence
  antisense sequence
ucuaauucuucaccgucuuc

SEQ ID NO: 576 - RNA, 20 nt, Artificial Sequence
  antisense sequence
guaucuaauucuucaccguc

SEQ ID NO: 577 - RNA, 20 nt, Artificial Sequence
  antisense sequence
cuguaucuaauucuucaccg

SEQ ID NO: 578 - RNA, 20 nt, Artificial Sequence
  antisense sequence
cuuggugguuuuggauuuag

SEQ ID NO: 579 - RNA, 20 nt, Artificial Sequence
  antisense sequence
cuucuuggugguuuuggauu

SEQ ID NO: 580 - RNA, 20 nt, Artificial Sequence
  antisense sequence
uuccuucuuggugguuuugg

SEQ ID NO: 581 - RNA, 20 nt, Artificial Sequence
  antisense sequence
uuuccuucuuggugguuuug

SEQ ID NO: 582 - RNA, 20 nt, Artificial Sequence
  antisense sequence
ucgccgucugcuuuuccuuc

SEQ ID NO: 583 - RNA, 20 nt, Artificial Sequence
  antisense sequence
uucgccgucugcuuuuccuu

SEQ ID NO: 584 - RNA, 20 nt, Artificial Sequence
  antisense sequence
auucgccgucugcuuuuccu

SEQ ID NO: 585 - RNA, 20 nt, Artificial Sequence
  antisense sequence
uauucgccgucugcuuuucc

SEQ ID NO: 586 - RNA, 20 nt, Artificial Sequence
  antisense sequence
auauucgccgucugcuuuuc

SEQ ID NO: 587 - RNA, 20 nt, Artificial Sequence
  antisense sequence
ggugcauuagcugacaaaau

SEQ ID NO: 588 - RNA, 20 nt, Artificial Sequence
  antisense sequence
gguggugcauuagcugacaa

SEQ ID NO: 589 - RNA, 20 nt, Artificial Sequence
  antisense sequence
agguggugcauuagcugaca

SEQ ID NO: 590 - RNA, 20 nt, Artificial Sequence
  antisense sequence
gagguggugcauuagcugac

SEQ ID NO: 591 - RNA, 20 nt, Artificial Sequence
  antisense sequence
ugagguggugcauuagcuga

SEQ ID NO: 592 - RNA, 20 nt, Artificial Sequence
  antisense sequence
gugagguggugcauuagcug

SEQ ID NO: 593 - RNA, 20 nt, Artificial Sequence
  antisense sequence
agugagguggugcauuagcu

SEQ ID NO: 594 - RNA, 20 nt, Artificial Sequence
  antisense sequence
cagugagguggugcauuagc

SEQ ID NO: 595 - RNA, 20 nt, Artificial Sequence
  antisense sequence
ucagugagguggugcauuag

SEQ ID NO: 596 - RNA, 20 nt, Artificial Sequence
  antisense sequence
uucagugagguggugcauua

SEQ ID NO: 597 - RNA, 20 nt, Artificial Sequence
  antisense sequence
uuucagugagguggugcauu

SEQ ID NO: 598 - RNA, 20 nt, Artificial Sequence
  antisense sequence
uuuucagugagguggugcau

SEQ ID NO: 599 - RNA, 20 nt, Artificial Sequence
  antisense sequence
gguuuucagugagguggugc

SEQ ID NO: 600 - RNA, 20 nt, Artificial Sequence
  antisense sequence
gugguuuucagugagguggu

SEQ ID NO: 601 - RNA, 20 nt, Artificial Sequence
  antisense sequence
uccuuccauaucuugugguu

SEQ ID NO: 602 - RNA, 20 nt, Artificial Sequence
  antisense sequence
cgauuuccuuccauaucuug

SEQ ID NO: 603 - RNA, 20 nt, Artificial Sequence
  antisense sequence
cucuacgauuuccuuccaua

SEQ ID NO: 604 - RNA, 20 nt, Artificial Sequence
  antisense sequence
ccucuacgauuuccuuccau

SEQ ID NO: 605 - RNA, 20 nt, Artificial Sequence
  antisense sequence
uccucuacgauuuccuucca

SEQ ID NO: 606 - RNA, 20 nt, Artificial Sequence
  antisense sequence
uuccucuacgauuuccuucc

SEQ ID NO: 607 - RNA, 20 nt, Artificial Sequence
  antisense sequence
cuuccucuacgauuuccuuc

SEQ ID NO: 608 - RNA, 20 nt, Artificial Sequence
  antisense sequence
ucuuccucuacgauuuccuu

SEQ ID NO: 609 - RNA, 20 nt, Artificial Sequence
  antisense sequence
uucuuccucuacgauuuccu

SEQ ID NO: 610 - RNA, 20 nt, Artificial Sequence
  antisense sequence
cuucuuccucuacgauuucc

SEQ ID NO: 611 - RNA, 20 nt, Artificial Sequence
  antisense sequence
ucuucuuccucuacgauuuc

SEQ ID NO: 612 - RNA, 20 nt, Artificial Sequence
  antisense sequence
ucaucugcuugagguaagga

SEQ ID NO: 613 - RNA, 20 nt, Artificial Sequence
  antisense sequence
ccugaaucucaucugcuuga

SEQ ID NO: 614 - RNA, 20 nt, Artificial Sequence
  antisense sequence
accugaaucucaucugcuug

SEQ ID NO: 615 - RNA, 20 nt, Artificial Sequence
  antisense sequence
aucugccucuucaauuaccu

SEQ ID NO: 616 - RNA, 20 nt, Artificial Sequence
  antisense sequence
ucuucaucugccucuucaau

SEQ ID NO: 617 - RNA, 20 nt, Artificial Sequence
  antisense sequence
cgcuauuccucuucaucugc

SEQ ID NO: 618 - RNA, 20 nt, Artificial Sequence
  antisense sequence
ucgcuauuccucuucaucug

SEQ ID NO: 619 - RNA, 20 nt, Artificial Sequence
  antisense sequence
ugucgcuauuccucuucauc

SEQ ID NO: 620 - RNA, 20 nt, Artificial Sequence
  antisense sequence
cugucgcuauuccucuucau

SEQ ID NO: 621 - RNA, 20 nt, Artificial Sequence
  antisense sequence
acugucgcuauuccucuuca

SEQ ID NO: 622 - RNA, 20 nt, Artificial Sequence
  antisense sequence
aacugucgcuauuccucuuc

SEQ ID NO: 623 - RNA, 20 nt, Artificial Sequence
  antisense sequence
cugggcuucuucaauaugac

SEQ ID NO: 624 - RNA, 20 nt, Artificial Sequence
  antisense sequence
acaacccucugggcuucuuc

SEQ ID NO: 625 - RNA, 20 nt, Artificial Sequence
  antisense sequence
cacaacccucugggcuucuu

SEQ ID NO: 626 - RNA, 20 nt, Artificial Sequence
  antisense sequence
gugaacacuaggcaaugauu

SEQ ID NO: 627 - RNA, 20 nt, Artificial Sequence
  antisense sequence
ggugaacacuaggcaaugau

SEQ ID NO: 628 - RNA, 20 nt, Artificial Sequence
  antisense sequence
cggugaacacuaggcaauga

SEQ ID NO: 629 - RNA, 20 nt, Artificial Sequence
  antisense sequence
ccggugaacacuaggcaaug

SEQ ID NO: 630 - RNA, 20 nt, Artificial Sequence
  antisense sequence
gccggugaacacuaggcaau

SEQ ID NO: 631 - RNA, 20 nt, Artificial Sequence
  antisense sequence
agccggugaacacuaggcaa

SEQ ID NO: 632 - RNA, 20 nt, Artificial Sequence
  antisense sequence
cagccggugaacacuaggca

SEQ ID NO: 633 - RNA, 20 nt, Artificial Sequence
  antisense sequence
ucagccggugaacacuaggc

SEQ ID NO: 634 - RNA, 20 nt, Artificial Sequence
  antisense sequence
gucagccggugaacacuagg

SEQ ID NO: 635 - RNA, 20 nt, Artificial Sequence
  antisense sequence
agucagccggugaacacuag

SEQ ID NO: 636 - RNA, 20 nt, Artificial Sequence
  antisense sequence
gagucagccggugaacacua

SEQ ID NO: 637 - RNA, 20 nt, Artificial Sequence
  antisense sequence
agagucagccggugaacacu

SEQ ID NO: 638 - RNA, 20 nt, Artificial Sequence
  antisense sequence
gagagucagccggugaacac

SEQ ID NO: 639 - RNA, 20 nt, Artificial Sequence
  antisense sequence
ugagagucagccggugaaca

SEQ ID NO: 640 - RNA, 20 nt, Artificial Sequence
  antisense sequence
uugagagucagccggugaac

SEQ ID NO: 641 - RNA, 20 nt, Artificial Sequence
  antisense sequence
caguugagagucagccggug

SEQ ID NO: 642 - RNA, 20 nt, Artificial Sequence
  antisense sequence
ucaguugagagucagccggu

SEQ ID NO: 643 - RNA, 20 nt, Artificial Sequence
  antisense sequence
uggucaguugagagucagcc

SEQ ID NO: 644 - RNA, 20 nt, Artificial Sequence
  antisense sequence
gaauggucaguugagaguca

SEQ ID NO: 645 - RNA, 20 nt, Artificial Sequence
  antisense sequence
ggaauggucaguugagaguc

SEQ ID NO: 646 - RNA, 20 nt, Artificial Sequence
  antisense sequence
caugggaauggucaguugag

SEQ ID NO: 647 - RNA, 20 nt, Artificial Sequence
  antisense sequence
acaugggaauggucaguuga

SEQ ID NO: 648 - RNA, 20 nt, Artificial Sequence
  antisense sequence
cacaugggaauggucaguug

SEQ ID NO: 649 - RNA, 20 nt, Artificial Sequence
  antisense sequence
uguccacaugggaaugguca

SEQ ID NO: 650 - RNA, 20 nt, Artificial Sequence
  antisense sequence
ccuguccacaugggaauggu

SEQ ID NO: 651 - RNA, 20 nt, Artificial Sequence
  antisense sequence
gccuguccacaugggaaugg

SEQ ID NO: 652 - RNA, 20 nt, Artificial Sequence
  antisense sequence
ggccuguccacaugggaaug

SEQ ID NO: 653 - RNA, 20 nt, Artificial Sequence
  antisense sequence
auccucucacaguauuaagg

SEQ ID NO: 654 - RNA, 20 nt, Artificial Sequence
  antisense sequence
cugccagcagagcaaggauc

SEQ ID NO: 655 - RNA, 20 nt, Artificial Sequence
  antisense sequence
acugccagcagagcaaggau

SEQ ID NO: 656 - RNA, 20 nt, Artificial Sequence
  antisense sequence
ugggaaacugccagcagagc

SEQ ID NO: 657 - RNA, 20 nt, Artificial Sequence
  antisense sequence
ugcauaggagugggaaacug

SEQ ID NO: 658 - RNA, 20 nt, Artificial Sequence
  antisense sequence
gugcauaggagugggaaacu

SEQ ID NO: 659 - RNA, 20 nt, Artificial Sequence
  antisense sequence
gaaagugcauaggaguggga

SEQ ID NO: 660 - RNA, 20 nt, Artificial Sequence
  antisense sequence
ugaaagugcauaggaguggg

SEQ ID NO: 661 - RNA, 20 nt, Artificial Sequence
  antisense sequence
uuccugugaaagugcauagg

SEQ ID NO: 662 - RNA, 20 nt, Artificial Sequence
  antisense sequence
guuccugugaaagugcauag

SEQ ID NO: 663 - RNA, 20 nt, Artificial Sequence
  antisense sequence
uaguuccugugaaagugcau

SEQ ID NO: 664 - RNA, 20 nt, Artificial Sequence
  antisense sequence
cuaguuccugugaaagugca

SEQ ID NO: 665 - RNA, 20 nt, Artificial Sequence
  antisense sequence
gucaacacggaugguauuuu

SEQ ID NO: 666 - RNA, 20 nt, Artificial Sequence
  antisense sequence
ugggucaacacggaugguau

SEQ ID NO: 667 - RNA, 20 nt, Artificial Sequence
  antisense sequence
augggucaacacggauggua

SEQ ID NO: 668 - RNA, 20 nt, Artificial Sequence
  antisense sequence
caugggucaacacggauggu

SEQ ID NO: 669 - RNA, 20 nt, Artificial Sequence
  antisense sequence
acaugggucaacacggaugg

SEQ ID NO: 670 - RNA, 20 nt, Artificial Sequence
  antisense sequence
aacaugggucaacacggaug

SEQ ID NO: 671 - RNA, 20 nt, Artificial Sequence
  antisense sequence
caacaugggucaacacggau

SEQ ID NO: 672 - RNA, 20 nt, Artificial Sequence
  antisense sequence
gcaacaugggucaacacgga

SEQ ID NO: 673 - RNA, 20 nt, Artificial Sequence
  antisense sequence
ugcaacaugggucaacacgg

SEQ ID NO: 674 - RNA, 20 nt, Artificial Sequence
  antisense sequence
cugcaacaugggucaacacg

SEQ ID NO: 675 - RNA, 20 nt, Artificial Sequence
  antisense sequence
ucugcaacaugggucaacac

SEQ ID NO: 676 - RNA, 20 nt, Artificial Sequence
  antisense sequence
ggcucugcaacaugggucaa

SEQ ID NO: 677 - RNA, 20 nt, Artificial Sequence
  antisense sequence
uaagggcucugcaacauggg

SEQ ID NO: 678 - RNA, 20 nt, Artificial Sequence
  antisense sequence
uaaguaagggcucugcaaca

SEQ ID NO: 679 - RNA, 20 nt, Artificial Sequence
  antisense sequence
uuaaguaagggcucugcaac

SEQ ID NO: 680 - RNA, 20 nt, Artificial Sequence
  antisense sequence
uuuaaguaagggcucugcaa

SEQ ID NO: 681 - RNA, 20 nt, Artificial Sequence
  antisense sequence
ggauuuaaguaagggcucug

SEQ ID NO: 682 - RNA, 20 nt, Artificial Sequence
  antisense sequence
ugaaggauuuaaguaagggc

SEQ ID NO: 683 - RNA, 20 nt, Artificial Sequence
  antisense sequence
caccagugaaggauuuaagu

SEQ ID NO: 684 - RNA, 20 nt, Artificial Sequence
  antisense sequence
ucauacaccagugaaggauu

SEQ ID NO: 685 - RNA, 20 nt, Artificial Sequence
  antisense sequence
cccagcaaagcagcauuaug

SEQ ID NO: 686 - RNA, 20 nt, Artificial Sequence
  antisense sequence
cuacccagcaaagcagcauu

SEQ ID NO: 687 - RNA, 20 nt, Artificial Sequence
  antisense sequence
acuacccagcaaagcagcau

SEQ ID NO: 688 - RNA, 20 nt, Artificial Sequence
  antisense sequence
cacuacccagcaaagcagca

SEQ ID NO: 689 - RNA, 20 nt, Artificial Sequence
  antisense sequence
gcucacuacccagcaaagca

SEQ ID NO: 690 - RNA, 20 nt, Artificial Sequence
  antisense sequence
agcucacuacccagcaaagc

SEQ ID NO: 691 - RNA, 20 nt, Artificial Sequence
  antisense sequence
caggcauagacuuuucucca

SEQ ID NO: 692 - RNA, 20 nt, Artificial Sequence
  antisense sequence
acaggcauagacuuuucucc

SEQ ID NO: 693 - RNA, 20 nt, Artificial Sequence
  antisense sequence
gacaggcauagacuuuucuc

SEQ ID NO: 694 - RNA, 20 nt, Artificial Sequence
  antisense sequence
agacaggcauagacuuuucu

SEQ ID NO: 695 - RNA, 20 nt, Artificial Sequence
  antisense sequence
uagacaggcauagacuuuuc

SEQ ID NO: 696 - RNA, 20 nt, Artificial Sequence
  antisense sequence
aaggcaacacuggauucauu

SEQ ID NO: 697 - RNA, 20 nt, Artificial Sequence
  antisense sequence
ucccucagaaaggcaacacu

SEQ ID NO: 698 - RNA, 20 nt, Artificial Sequence
  antisense sequence
aucccucagaaaggcaacac

SEQ ID NO: 699 - RNA, 20 nt, Artificial Sequence
  antisense sequence
aaucccucagaaaggcaaca

SEQ ID NO: 700 - RNA, 20 nt, Artificial Sequence
  antisense sequence
gaaaucccucagaaaggcaa

SEQ ID NO: 701 - RNA, 20 nt, Artificial Sequence
  antisense sequence
gcagaaaucccucagaaagg

SEQ ID NO: 702 - RNA, 20 nt, Artificial Sequence
  antisense sequence
guguauugcauugagcagaa

SEQ ID NO: 703 - RNA, 20 nt, Artificial Sequence
  antisense sequence
caguguauugcauugagcag

SEQ ID NO: 704 - RNA, 20 nt, Artificial Sequence
  antisense sequence
acaguguauugcauugagca

SEQ ID NO: 705 - RNA, 20 nt, Artificial Sequence
  antisense sequence
ggagaauagcacugaacagu

SEQ ID NO: 706 - RNA, 20 nt, Artificial Sequence
  antisense sequence
gggagaauagcacugaacag

SEQ ID NO: 707 - RNA, 20 nt, Artificial Sequence
  antisense sequence
cuagcugggagaauagcacu

SEQ ID NO: 708 - RNA, 20 nt, Artificial Sequence
  antisense sequence
ccuagcugggagaauagcac

SEQ ID NO: 709 - RNA, 20 nt, Artificial Sequence
  antisense sequence
accuagcugggagaauagca

SEQ ID NO: 710 - RNA, 20 nt, Artificial Sequence
  antisense sequence
aaccuagcugggagaauagc

SEQ ID NO: 711 - RNA, 20 nt, Artificial Sequence
  antisense sequence
aaaccuagcugggagaauag

SEQ ID NO: 712 - RNA, 20 nt, Artificial Sequence
  antisense sequence
uaaaccuagcugggagaaua

SEQ ID NO: 713 - RNA, 20 nt, Artificial Sequence
  antisense sequence
gauaaaccuagcugggagaa

SEQ ID NO: 714 - RNA, 20 nt, Artificial Sequence
  antisense sequence
ggauaaaccuagcugggaga

SEQ ID NO: 715 - RNA, 20 nt, Artificial Sequence
  antisense sequence
uggauaaaccuagcugggag

SEQ ID NO: 716 - RNA, 20 nt, Artificial Sequence
  antisense sequence
cauggauaaaccuagcuggg

SEQ ID NO: 717 - RNA, 20 nt, Artificial Sequence
  antisense sequence
ucauggauaaaccuagcugg

SEQ ID NO: 718 - RNA, 20 nt, Artificial Sequence
  antisense sequence
uucauggauaaaccuagcug

SEQ ID NO: 719 - RNA, 20 nt, Artificial Sequence
  antisense sequence
cuucauggauaaaccuagcu

SEQ ID NO: 720 - RNA, 20 nt, Artificial Sequence
  antisense sequence
ccuucauggauaaaccuagc

SEQ ID NO: 721 - RNA, 20 nt, Artificial Sequence
  antisense sequence
uccuucauggauaaaccuag

SEQ ID NO: 722 - RNA, 20 nt, Artificial Sequence
  antisense sequence
guccuucauggauaaaccua

SEQ ID NO: 723 - RNA, 20 nt, Artificial Sequence
  antisense sequence
aguccuucauggauaaaccu

SEQ ID NO: 724 - RNA, 20 nt, Artificial Sequence
  antisense sequence
caguccuucauggauaaacc

SEQ ID NO: 725 - RNA, 20 nt, Artificial Sequence
  antisense sequence
ucaguccuucauggauaaac

SEQ ID NO: 726 - RNA, 20 nt, Artificial Sequence
  antisense sequence
cucaguccuucauggauaaa

SEQ ID NO: 727 - RNA, 20 nt, Artificial Sequence
  antisense sequence
acucaguccuucauggauaa

SEQ ID NO: 728 - RNA, 20 nt, Artificial Sequence
  antisense sequence
gucacucaguccuucaugga

SEQ ID NO: 729 - RNA, 20 nt, Artificial Sequence
  antisense sequence
aggucacucaguccuucaug

SEQ ID NO: 730 - RNA, 20 nt, Artificial Sequence
  antisense sequence
caacaaaggucacucagucc

SEQ ID NO: 731 - RNA, 20 nt, Artificial Sequence
  antisense sequence
acaacaaaggucacucaguc

SEQ ID NO: 732 - RNA, 20 nt, Artificial Sequence
  antisense sequence
uacaacaaaggucacucagu

SEQ ID NO: 733 - RNA, 20 nt, Artificial Sequence
  antisense sequence
auacaacaaaggucacucag

SEQ ID NO: 734 - RNA, 20 nt, Artificial Sequence
  antisense sequence
gaugcaccuggauuuuguua

SEQ ID NO: 735 - RNA, 20 nt, Artificial Sequence
  antisense sequence
auugaugcaccuggauuuug

SEQ ID NO: 736 - RNA, 20 nt, Artificial Sequence
  antisense sequence
gaaauugaugcaccuggauu

SEQ ID NO: 737 - RNA, 20 nt, Artificial Sequence
  antisense sequence
agaaauugaugcaccuggau

SEQ ID NO: 738 - RNA, 20 nt, Artificial Sequence
  antisense sequence
cagaaauugaugcaccugga

SEQ ID NO: 739 - RNA, 20 nt, Artificial Sequence
  antisense sequence
ucagaaauugaugcaccugg

SEQ ID NO: 740 - RNA, 20 nt, Artificial Sequence
  antisense sequence
uggcaaaccugaauacucuc

SEQ ID NO: 741 - RNA, 20 nt, Artificial Sequence
  antisense sequence
auggcaaaccugaauacucu

SEQ ID NO: 742 - RNA, 20 nt, Artificial Sequence
  antisense sequence
cauggcaaaccugaauacuc

SEQ ID NO: 743 - RNA, 20 nt, Artificial Sequence
  antisense sequence
ggaacauaagauaagacugg

SEQ ID NO: 744 - RNA, 20 nt, Artificial Sequence
  antisense sequence
gaauccugagcuagaguaaa

SEQ ID NO: 745 - RNA, 20 nt, Artificial Sequence
  antisense sequence
cgaauccugagcuagaguaa

SEQ ID NO: 746 - RNA, 20 nt, Artificial Sequence
  antisense sequence
acgaauccugagcuagagua

SEQ ID NO: 747 - RNA, 20 nt, Artificial Sequence
  antisense sequence
uacgaauccugagcuagagu

SEQ ID NO: 748 - RNA, 20 nt, Artificial Sequence
  antisense sequence
auacgaauccugagcuagag

SEQ ID NO: 749 - RNA, 20 nt, Artificial Sequence
  antisense sequence
aauacgaauccugagcuaga

SEQ ID NO: 750 - RNA, 20 nt, Artificial Sequence
  antisense sequence
ccuuuagggcucacuauauu

SEQ ID NO: 751 - RNA, 20 nt, Artificial Sequence
  antisense sequence
guguccuuuagggcucacua

SEQ ID NO: 752 - RNA, 20 nt, Artificial Sequence
  antisense sequence
auguguccuuuagggcucac

SEQ ID NO: 753 - RNA, 20 nt, Artificial Sequence
  antisense sequence
auguauguguccuuuagggc

SEQ ID NO: 754 - RNA, 20 nt, Artificial Sequence
  antisense sequence
augacagcuaagauguggau

SEQ ID NO: 755 - RNA, 20 nt, Artificial Sequence
  antisense sequence
gugaacaaaugacagcuaag

SEQ ID NO: 756 - RNA, 20 nt, Artificial Sequence
  antisense sequence
uaggcagagggaaauuaaca

SEQ ID NO: 757 - RNA, 20 nt, Artificial Sequence
  antisense sequence
ucuuuaggcagagggaaauu

SEQ ID NO: 758 - RNA, 20 nt, Artificial Sequence
  antisense sequence
gucuuuaggcagagggaaau

SEQ ID NO: 759 - RNA, 20 nt, Artificial Sequence
  antisense sequence
guagucuuuaggcagaggga

SEQ ID NO: 760 - RNA, 20 nt, Artificial Sequence
  antisense sequence
uguagucuuuaggcagaggg

SEQ ID NO: 761 - RNA, 20 nt, Artificial Sequence
  antisense sequence
auguagucuuuaggcagagg

SEQ ID NO: 762 - RNA, 20 nt, Artificial Sequence
  antisense sequence
cauguagucuuuaggcagag

SEQ ID NO: 763 - RNA, 20 nt, Artificial Sequence
  antisense sequence
ucauguagucuuuaggcaga

SEQ ID NO: 764 - RNA, 20 nt, Artificial Sequence
  antisense sequence
gucauguagucuuuaggcag

SEQ ID NO: 765 - RNA, 20 nt, Artificial Sequence
  antisense sequence
ugucauguagucuuuaggca

SEQ ID NO: 766 - RNA, 20 nt, Artificial Sequence
  antisense sequence
cugucauguagucuuuaggc

SEQ ID NO: 767 - RNA, 20 nt, Artificial Sequence
  antisense sequence
ucugucauguagucuuuagg

SEQ ID NO: 768 - RNA, 20 nt, Artificial Sequence
  antisense sequence
gucauuucugucauguaguc

SEQ ID NO: 769 - RNA, 20 nt, Artificial Sequence
  antisense sequence
agugauaggucauuucuguc

SEQ ID NO: 770 - RNA, 20 nt, Artificial Sequence
  antisense sequence
guagugauaggucauuucug

SEQ ID NO: 771 - RNA, 20 nt, Artificial Sequence
  antisense sequence
agucuugcaguuaggcuuca

SEQ ID NO: 772 - RNA, 20 nt, Artificial Sequence
  antisense sequence
cagucuugcaguuaggcuuc

SEQ ID NO: 773 - RNA, 20 nt, Artificial Sequence
  antisense sequence
ucagucuugcaguuaggcuu

SEQ ID NO: 774 - RNA, 20 nt, Artificial Sequence
  antisense sequence
aucagucuugcaguuaggcu

SEQ ID NO: 775 - RNA, 20 nt, Artificial Sequence
  antisense sequence
aaucagucuugcaguuaggc

SEQ ID NO: 776 - RNA, 20 nt, Artificial Sequence
  antisense sequence
aaaucagucuugcaguuagg

SEQ ID NO: 777 - RNA, 20 nt, Artificial Sequence
  antisense sequence
cagaaaucagucuugcaguu

SEQ ID NO: 778 - RNA, 20 nt, Artificial Sequence
  antisense sequence
cucagaaaucagucuugcag

SEQ ID NO: 779 - RNA, 20 nt, Artificial Sequence
  antisense sequence
ucucagaaaucagucuugca

SEQ ID NO: 780 - RNA, 20 nt, Artificial Sequence
  antisense sequence
ccaguucuuuacuuguucuc

SEQ ID NO: 781 - RNA, 20 nt, Artificial Sequence
  antisense sequence
cacacacuagcaaguuuaca

SEQ ID NO: 782 - RNA, 20 nt, Artificial Sequence
  antisense sequence
ccacacacuagcaaguuuac

SEQ ID NO: 783 - RNA, 20 nt, Artificial Sequence
  antisense sequence
uccacacacuagcaaguuua

SEQ ID NO: 784 - RNA, 20 nt, Artificial Sequence
  antisense sequence
auccacacacuagcaaguuu

SEQ ID NO: 785 - RNA, 20 nt, Artificial Sequence
  antisense sequence
uauccacacacuagcaaguu

SEQ ID NO: 786 - RNA, 20 nt, Artificial Sequence
  antisense sequence
auauccacacacuagcaagu

SEQ ID NO: 787 - RNA, 20 nt, Artificial Sequence
  antisense sequence
gguacauauccacacacuag

SEQ ID NO: 788 - RNA, 20 nt, Artificial Sequence
  antisense sequence
ggguacauauccacacacua

SEQ ID NO: 789 - RNA, 20 nt, Artificial Sequence
  antisense sequence
uaggguacauauccacacac

SEQ ID NO: 790 - RNA, 20 nt, Artificial Sequence
  antisense sequence
guaggguacauauccacaca

SEQ ID NO: 791 - RNA, 20 nt, Artificial Sequence
  antisense sequence
caaguaggguacauauccac

SEQ ID NO: 792 - RNA, 20 nt, Artificial Sequence
  antisense sequence
ucacaaguaggguacauauc

SEQ ID NO: 793 - RNA, 20 nt, Artificial Sequence
  antisense sequence
guauuucacaaguaggguac

SEQ ID NO: 794 - RNA, 20 nt, Artificial Sequence
  antisense sequence
caucauuuuggcugcucuuu

SEQ ID NO: 795 - RNA, 20 nt, Artificial Sequence
  antisense sequence
uagccuaccauuuugccauc

SEQ ID NO: 796 - RNA, 20 nt, Artificial Sequence
  antisense sequence
auuagccuaccauuuugcca

SEQ ID NO: 797 - RNA, 20 nt, Artificial Sequence
  antisense sequence
uauuagccuaccauuuugcc

SEQ ID NO: 798 - RNA, 20 nt, Artificial Sequence
  antisense sequence
gguuucacugugugcaaaau

SEQ ID NO: 799 - RNA, 20 nt, Artificial Sequence
  antisense sequence
ugguuucacugugugcaaaa

SEQ ID NO: 800 - RNA, 20 nt, Artificial Sequence
  antisense sequence
augguuucacugugugcaaa

SEQ ID NO: 801 - RNA, 20 nt, Artificial Sequence
  antisense sequence
aaugguuucacugugugcaa

SEQ ID NO: 802 - RNA, 20 nt, Artificial Sequence
  antisense sequence
uaaugguuucacugugugca

SEQ ID NO: 803 - RNA, 20 nt, Artificial Sequence
  antisense sequence
uuaaugguuucacugugugc

SEQ ID NO: 804 - RNA, 20 nt, Artificial Sequence
  antisense sequence
gacacugugaaggaucaaaa

SEQ ID NO: 805 - RNA, 20 nt, Artificial Sequence
  antisense sequence
ugacacugugaaggaucaaa

SEQ ID NO: 806 - RNA, 20 nt, Artificial Sequence
  antisense sequence
auugacacugugaaggauca

SEQ ID NO: 807 - RNA, 20 nt, Artificial Sequence
  antisense sequence
cacucacucaacacgucuaa

SEQ ID NO: 808 - RNA, 20 nt, Artificial Sequence
  antisense sequence
gcacucacucaacacgucua

SEQ ID NO: 809 - RNA, 20 nt, Artificial Sequence
  antisense sequence
agcacucacucaacacgucu

SEQ ID NO: 810 - RNA, 20 nt, Artificial Sequence
  antisense sequence
cagcacucacucaacacguc

SEQ ID NO: 811 - RNA, 20 nt, Artificial Sequence
  antisense sequence
cucagcacucacucaacacg

SEQ ID NO: 812 - RNA, 20 nt, Artificial Sequence
  antisense sequence
caaggaacucagcacucacu

SEQ ID NO: 813 - RNA, 20 nt, Artificial Sequence
  antisense sequence
gcaaggaacucagcacucac

SEQ ID NO: 814 - RNA, 20 nt, Artificial Sequence
  antisense sequence
cagcaaggaacucagcacuc

SEQ ID NO: 815 - RNA, 20 nt, Artificial Sequence
  antisense sequence
gcagcaaggaacucagcacu

SEQ ID NO: 816 - RNA, 20 nt, Artificial Sequence
  antisense sequence
ggcagcaaggaacucagcac

SEQ ID NO: 817 - RNA, 20 nt, Artificial Sequence
  antisense sequence
uggcagcaaggaacucagca

SEQ ID NO: 818 - RNA, 20 nt, Artificial Sequence
  antisense sequence
aacaaaaguggcagcaagga

SEQ ID NO: 819 - RNA, 20 nt, Artificial Sequence
  antisense sequence
uaacaaaaguggcagcaagg

SEQ ID NO: 820 - RNA, 20 nt, Artificial Sequence
  antisense sequence
gguaacaaaaguggcagcaa

SEQ ID NO: 821 - RNA, 20 nt, Artificial Sequence
  antisense sequence
caaugguaacaaaaguggca

SEQ ID NO: 822 - RNA, 20 nt, Artificial Sequence
  antisense sequence
gacaaugguaacaaaagugg

SEQ ID NO: 823 - RNA, 20 nt, Artificial Sequence
  antisense sequence
gugugugacaaugguaacaa

SEQ ID NO: 824 - RNA, 20 nt, Artificial Sequence
  antisense sequence
agugugugacaaugguaaca

SEQ ID NO: 825 - RNA, 20 nt, Artificial Sequence
  antisense sequence
uagugugugacaaugguaac

SEQ ID NO: 826 - RNA, 20 nt, Artificial Sequence
  antisense sequence
cauagugugugacaauggua

SEQ ID NO: 827 - RNA, 20 nt, Artificial Sequence
  antisense sequence
ggacugguuuacacauagug

SEQ ID NO: 828 - RNA, 20 nt, Artificial Sequence
  antisense sequence
gggacugguuuacacauagu

SEQ ID NO: 829 - RNA, 20 nt, Artificial Sequence
  antisense sequence
ugggacugguuuacacauag

SEQ ID NO: 830 - RNA, 20 nt, Artificial Sequence
  antisense sequence
gugggacugguuuacacaua

SEQ ID NO: 831 - RNA, 20 nt, Artificial Sequence
  antisense sequence
ggugggacugguuuacacau

SEQ ID NO: 832 - RNA, 20 nt, Artificial Sequence
  antisense sequence
cagacaguauggaaauguga

SEQ ID NO: 833 - RNA, 20 nt, Artificial Sequence
  antisense sequence
acagacaguauggaaaugug

SEQ ID NO: 834 - RNA, 20 nt, Artificial Sequence
  antisense sequence
gaguuuccaguaguaauugg

SEQ ID NO: 835 - RNA, 20 nt, Artificial Sequence
  antisense sequence
gucaauuacuuagcaagggu

SEQ ID NO: 836 - RNA, 20 nt, Artificial Sequence
  antisense sequence
ggguuucuuuaggcuaguua

SEQ ID NO: 837 - RNA, 20 nt, Artificial Sequence
  antisense sequence
uggguuucuuuaggcuaguu

SEQ ID NO: 838 - RNA, 20 nt, Artificial Sequence
  antisense sequence
uuggguuucuuuaggcuagu

SEQ ID NO: 839 - RNA, 20 nt, Artificial Sequence
  antisense sequence
uuuggguuucuuuaggcuag

SEQ ID NO: 840 - RNA, 20 nt, Artificial Sequence
  antisense sequence
agcucgggagagauacuuuu

SEQ ID NO: 841 - RNA, 20 nt, Artificial Sequence
  antisense sequence
cagcucgggagagauacuuu

SEQ ID NO: 842 - RNA, 20 nt, Artificial Sequence
  antisense sequence
ucagcucgggagagauacuu

SEQ ID NO: 843 - RNA, 20 nt, Artificial Sequence
  antisense sequence
uucagcucgggagagauacu

SEQ ID NO: 844 - RNA, 20 nt, Artificial Sequence
  antisense sequence
uuucagcucgggagagauac

SEQ ID NO: 845 - RNA, 20 nt, Artificial Sequence
  antisense sequence
guuucagcucgggagagaua

SEQ ID NO: 846 - RNA, 20 nt, Artificial Sequence
  antisense sequence
aguuucagcucgggagagau

SEQ ID NO: 847 - RNA, 20 nt, Artificial Sequence
  antisense sequence
aaguuucagcucgggagaga

SEQ ID NO: 848 - RNA, 20 nt, Artificial Sequence
  antisense sequence
uaaguuucagcucgggagag

SEQ ID NO: 849 - RNA, 20 nt, Artificial Sequence
  antisense sequence
uuaaguuucagcucgggaga

SEQ ID NO: 850 - RNA, 20 nt, Artificial Sequence
  antisense sequence
uuuaaguuucagcucgggag

SEQ ID NO: 851 - RNA, 20 nt, Artificial Sequence
  antisense sequence
ucuaaugguacagugugcau

SEQ ID NO: 852 - RNA, 20 nt, Artificial Sequence
  antisense sequence
aucuaaugguacagugugca

SEQ ID NO: 853 - RNA, 20 nt, Artificial Sequence
  antisense sequence
caucuaaugguacagugugc

SEQ ID NO: 854 - RNA, 20 nt, Artificial Sequence
  antisense sequence
ucaucuaaugguacagugug

SEQ ID NO: 855 - RNA, 20 nt, Artificial Sequence
  antisense sequence
auggcuuauggcaauuucuc

SEQ ID NO: 856 - RNA, 20 nt, Artificial Sequence
  antisense sequence
cuguaauauggcuuauggca

SEQ ID NO: 857 - RNA, 20 nt, Artificial Sequence
  antisense sequence
ucuaguaccagcggcuuuaa

SEQ ID NO: 858 - RNA, 20 nt, Artificial Sequence
  antisense sequence
uucuaguaccagcggcuuua

SEQ ID NO: 859 - RNA, 20 nt, Artificial Sequence
  antisense sequence
uuucuaguaccagcggcuuu

SEQ ID NO: 860 - RNA, 20 nt, Artificial Sequence
  antisense sequence
auuucuaguaccagcggcuu

SEQ ID NO: 861 - RNA, 20 nt, Artificial Sequence
  antisense sequence
uauuucuaguaccagcggcu

SEQ ID NO: 862 - RNA, 20 nt, Artificial Sequence
  antisense sequence
auauuucuaguaccagcggc

SEQ ID NO: 863 - RNA, 20 nt, Artificial Sequence
  antisense sequence
gugucaguagguacauagau

SEQ ID NO: 864 - RNA, 20 nt, Artificial Sequence
  antisense sequence
ugugucaguagguacauaga

SEQ ID NO: 865 - RNA, 19 nt, Artificial Sequence
  siRNA sense sequence
cucuccucagccagcaugu

SEQ ID NO: 866 - RNA, 19 nt, Artificial Sequence
  siRNA antisense sequence
acaugcuggcugaggagag

SEQ ID NO: 867 - RNA, 19 nt, Artificial Sequence
  siRNA sense sequence
ucuccucagccagcauguc

SEQ ID NO: 868 - RNA, 19 nt, Artificial Sequence
  siRNA antisense sequence
gacaugcuggcugaggaga

SEQ ID NO: 869 - RNA, 19 nt, Artificial Sequence
  siRNA sense sequence
cuccucagccagcaugucc

SEQ ID NO: 870 - RNA, 19 nt, Artificial Sequence
  siRNA antisense sequence
ggacaugcuggcugaggag

SEQ ID NO: 871 - RNA, 19 nt, Artificial Sequence
  siRNA sense sequence
ucagccagcaugucccgga

SEQ ID NO: 872 - RNA, 19 nt, Artificial Sequence
  siRNA antisense sequence
uccgggacaugcuggcuga

SEQ ID NO: 873 - RNA, 19 nt, Artificial Sequence
  siRNA sense sequence
agccagcaugucccggacu

SEQ ID NO: 874 - RNA, 19 nt, Artificial Sequence
  siRNA antisense sequence
aguccgggacaugcuggcu

SEQ ID NO: 875 - RNA, 19 nt, Artificial Sequence
  siRNA sense sequence
agcccugacggguugcgaa

SEQ ID NO: 876 - RNA, 19 nt, Artificial Sequence
  siRNA antisense sequence
uucgcaacccgucagggcu

SEQ ID NO: 877 - RNA, 19 nt, Artificial Sequence
  siRNA sense sequence
cagccaugaggagggacga

SEQ ID NO: 878 - RNA, 19 nt, Artificial Sequence
  siRNA antisense sequence
ucgucccuccucauggcug

SEQ ID NO: 879 - RNA, 19 nt, Artificial Sequence
  siRNA sense sequence
agccaugaggagggacgag

SEQ ID NO: 880 - RNA, 19 nt, Artificial Sequence
  siRNA antisense sequence
cucgucccuccucauggcu

SEQ ID NO: 881 - RNA, 19 nt, Artificial Sequence
  siRNA sense sequence
augaggagggacgagcgag

SEQ ID NO: 882 - RNA, 19 nt, Artificial Sequence
  siRNA antisense sequence
cucgcucgucccuccucau

SEQ ID NO: 883 - RNA, 19 nt, Artificial Sequence
  siRNA sense sequence
agacgccaaagccaugcgg

SEQ ID NO: 884 - RNA, 19 nt, Artificial Sequence
  siRNA antisense sequence
ccgcauggcuuuggcgucu

SEQ ID NO: 885 - RNA, 19 nt, Artificial Sequence
  siRNA sense sequence
gacgccaaagccaugcggu

SEQ ID NO: 886 - RNA, 19 nt, Artificial Sequence
  siRNA antisense sequence
accgcauggcuuuggcguc

SEQ ID NO: 887 - RNA, 19 nt, Artificial Sequence
  siRNA sense sequence
acgccaaagccaugcgguc

SEQ ID NO: 888 - RNA, 19 nt, Artificial Sequence
  siRNA antisense sequence
gaccgcauggcuuuggcgu

SEQ ID NO: 889 - RNA, 19 nt, Artificial Sequence
  siRNA sense sequence
ccaaagccaugcggucccu

SEQ ID NO: 890 - RNA, 19 nt, Artificial Sequence
  siRNA antisense sequence
agggaccgcauggcuuugg

SEQ ID NO: 891 - RNA, 19 nt, Artificial Sequence
  siRNA sense sequence
caaagccaugcggucccug

SEQ ID NO: 892 - RNA, 19 nt, Artificial Sequence
  siRNA antisense sequence
cagggaccgcauggcuuug

SEQ ID NO: 893 - RNA, 19 nt, Artificial Sequence
  siRNA sense sequence
aacggcuacgugaagagcu

SEQ ID NO: 894 - RNA, 19 nt, Artificial Sequence
  siRNA antisense sequence
agcucuucacguagccguu

SEQ ID NO: 895 - RNA, 19 nt, Artificial Sequence
  siRNA sense sequence
acggcuacgugaagagcug

SEQ ID NO: 896 - RNA, 19 nt, Artificial Sequence
  siRNA antisense sequence
cagcucuucacguagccgu

SEQ ID NO: 897 - RNA, 19 nt, Artificial Sequence
  siRNA sense sequence
cggcuacgugaagagcugc

SEQ ID NO: 898 - RNA, 19 nt, Artificial Sequence
  siRNA antisense sequence
gcagcucuucacguagccg

SEQ ID NO: 899 - RNA, 19 nt, Artificial Sequence
  siRNA sense sequence
ggcuacgugaagagcugcg

SEQ ID NO: 900 - RNA, 19 nt, Artificial Sequence
  siRNA antisense sequence
cgcagcucuucacguagcc

SEQ ID NO: 901 - RNA, 19 nt, Artificial Sequence
  siRNA sense sequence
gcuacgugaagagcugcgu

SEQ ID NO: 902 - RNA, 19 nt, Artificial Sequence
  siRNA antisense sequence
acgcagcucuucacguagc

SEQ ID NO: 903 - RNA, 19 nt, Artificial Sequence
  siRNA sense sequence
cuacgugaagagcugcgug

SEQ ID NO: 904 - RNA, 19 nt, Artificial Sequence
  siRNA antisense sequence
cacgcagcucuucacguag

SEQ ID NO: 905 - RNA, 19 nt, Artificial Sequence
  siRNA sense sequence
uacgugaagagcugcguga

SEQ ID NO: 906 - RNA, 19 nt, Artificial Sequence
  siRNA antisense sequence
ucacgcagcucuucacgua

SEQ ID NO: 907 - RNA, 19 nt, Artificial Sequence
  siRNA sense sequence
acgugaagagcugcgugag

SEQ ID NO: 908 - RNA, 19 nt, Artificial Sequence
  siRNA antisense sequence
cucacgcagcucuucacgu

SEQ ID NO: 909 - RNA, 19 nt, Artificial Sequence
  siRNA sense sequence
cgugaagagcugcgugagc

SEQ ID NO: 910 - RNA, 19 nt, Artificial Sequence
  siRNA antisense sequence
gcucacgcagcucuucacg

SEQ ID NO: 911 - RNA, 19 nt, Artificial Sequence
  siRNA sense sequence
gcggcuucuucuuccaccu

SEQ ID NO: 912 - RNA, 19 nt, Artificial Sequence
  siRNA antisense sequence
agguggaagaagaagccgc

SEQ ID NO: 913 - RNA, 19 nt, Artificial Sequence
  siRNA sense sequence
cggcuucuucuuccaccuc

SEQ ID NO: 914 - RNA, 19 nt, Artificial Sequence
  siRNA antisense sequence
gagguggaagaagaagccg

SEQ ID NO: 915 - RNA, 19 nt, Artificial Sequence
  siRNA sense sequence
ggcuucuucuuccaccucu

SEQ ID NO: 916 - RNA, 19 nt, Artificial Sequence
  siRNA antisense sequence
agagguggaagaagaagcc

SEQ ID NO: 917 - RNA, 19 nt, Artificial Sequence
  siRNA sense sequence
gcuucuucuuccaccucug

SEQ ID NO: 918 - RNA, 19 nt, Artificial Sequence
  siRNA antisense sequence
cagagguggaagaagaagc

SEQ ID NO: 919 - RNA, 19 nt, Artificial Sequence
  siRNA sense sequence
uccaccucugccgcuucug

SEQ ID NO: 920 - RNA, 19 nt, Artificial Sequence
  siRNA antisense sequence
cagaagcggcagaggugga

SEQ ID NO: 921 - RNA, 19 nt, Artificial Sequence
  siRNA sense sequence
accucugccgcuucugcaa

SEQ ID NO: 922 - RNA, 19 nt, Artificial Sequence
  siRNA antisense sequence
uugcagaagcggcagaggu

SEQ ID NO: 923 - RNA, 19 nt, Artificial Sequence
  siRNA sense sequence
ccucugccgcuucugcaac

SEQ ID NO: 924 - RNA, 19 nt, Artificial Sequence
  siRNA antisense sequence
guugcagaagcggcagagg

SEQ ID NO: 925 - RNA, 19 nt, Artificial Sequence
  siRNA sense sequence
cucugccgcuucugcaacg

SEQ ID NO: 926 - RNA, 19 nt, Artificial Sequence
  siRNA antisense sequence
cguugcagaagcggcagag

SEQ ID NO: 927 - RNA, 19 nt, Artificial Sequence
  siRNA sense sequence
ucugccgcuucugcaacgu

SEQ ID NO: 928 - RNA, 19 nt, Artificial Sequence
  siRNA antisense sequence
acguugcagaagcggcaga

SEQ ID NO: 929 - RNA, 19 nt, Artificial Sequence
  siRNA sense sequence
cugccgcuucugcaacgug

SEQ ID NO: 930 - RNA, 19 nt, Artificial Sequence
  siRNA antisense sequence
cacguugcagaagcggcag

SEQ ID NO: 931 - RNA, 19 nt, Artificial Sequence
  siRNA sense sequence
ugccgcuucugcaacgugg

SEQ ID NO: 932 - RNA, 19 nt, Artificial Sequence
  siRNA antisense sequence
ccacguugcagaagcggca

SEQ ID NO: 933 - RNA, 19 nt, Artificial Sequence
  siRNA sense sequence
gccgcuucugcaacgugga

SEQ ID NO: 934 - RNA, 19 nt, Artificial Sequence
  siRNA antisense sequence
uccacguugcagaagcggc

SEQ ID NO: 935 - RNA, 19 nt, Artificial Sequence
  siRNA sense sequence
ccgcuucugcaacguggag

SEQ ID NO: 936 - RNA, 19 nt, Artificial Sequence
  siRNA antisense sequence
cuccacguugcagaagcgg

SEQ ID NO: 937 - RNA, 19 nt, Artificial Sequence
  siRNA sense sequence
cgcuucugcaacguggagc

SEQ ID NO: 938 - RNA, 19 nt, Artificial Sequence
  siRNA antisense sequence
gcuccacguugcagaagcg

SEQ ID NO: 939 - RNA, 19 nt, Artificial Sequence
  siRNA sense sequence
gcuucugcaacguggagcu

SEQ ID NO: 940 - RNA, 19 nt, Artificial Sequence
  siRNA antisense sequence
agcuccacguugcagaagc

SEQ ID NO: 941 - RNA, 19 nt, Artificial Sequence
  siRNA sense sequence
cuucugcaacguggagcug

SEQ ID NO: 942 - RNA, 19 nt, Artificial Sequence
  siRNA antisense sequence
cagcuccacguugcagaag

SEQ ID NO: 943 - RNA, 19 nt, Artificial Sequence
  siRNA sense sequence
uucugcaacguggagcugc

SEQ ID NO: 944 - RNA, 19 nt, Artificial Sequence
  siRNA antisense sequence
gcagcuccacguugcagaa

SEQ ID NO: 945 - RNA, 19 nt, Artificial Sequence
  siRNA sense sequence
ccuggcugccuuuguccuc

SEQ ID NO: 946 - RNA, 19 nt, Artificial Sequence
  siRNA antisense sequence
gaggacaaaggcagccagg

SEQ ID NO: 947 - RNA, 19 nt, Artificial Sequence
  siRNA sense sequence
cugccuuuguccucgcccu

SEQ ID NO: 948 - RNA, 19 nt, Artificial Sequence
  siRNA antisense sequence
agggcgaggacaaaggcag

SEQ ID NO: 949 - RNA, 19 nt, Artificial Sequence
  siRNA sense sequence
ugccuuuguccucgcccug

SEQ ID NO: 950 - RNA, 19 nt, Artificial Sequence
  siRNA antisense sequence
cagggcgaggacaaaggca

SEQ ID NO: 951 - RNA, 19 nt, Artificial Sequence
  siRNA sense sequence
gcugcugagcguguguucg

SEQ ID NO: 952 - RNA, 19 nt, Artificial Sequence
  siRNA antisense sequence
cgaacacacgcucagcagc

SEQ ID NO: 953 - RNA, 19 nt, Artificial Sequence
  siRNA sense sequence
cugcugagcguguguucgc

SEQ ID NO: 954 - RNA, 19 nt, Artificial Sequence
  siRNA antisense sequence
gcgaacacacgcucagcag

SEQ ID NO: 955 - RNA, 19 nt, Artificial Sequence
  siRNA sense sequence
ugcugagcguguguucgca

SEQ ID NO: 956 - RNA, 19 nt, Artificial Sequence
  siRNA antisense sequence
ugcgaacacacgcucagca

SEQ ID NO: 957 - RNA, 19 nt, Artificial Sequence
  siRNA sense sequence
gcugagcguguguucgcac

SEQ ID NO: 958 - RNA, 19 nt, Artificial Sequence
  siRNA antisense sequence
gugcgaacacacgcucagc

SEQ ID NO: 959 - RNA, 19 nt, Artificial Sequence
  siRNA sense sequence
guguucgcacagcuugagc

SEQ ID NO: 960 - RNA, 19 nt, Artificial Sequence
  siRNA antisense sequence
gcucaagcugugcgaacac

SEQ ID NO: 961 - RNA, 19 nt, Artificial Sequence
  siRNA sense sequence
cccucuucagcaucgccug

SEQ ID NO: 962 - RNA, 19 nt, Artificial Sequence
  siRNA antisense sequence
caggcgaugcugaagaggg

SEQ ID NO: 963 - RNA, 19 nt, Artificial Sequence
  siRNA sense sequence
ccucuucagcaucgccugu

SEQ ID NO: 964 - RNA, 19 nt, Artificial Sequence
  siRNA antisense sequence
acaggcgaugcugaagagg

SEQ ID NO: 965 - RNA, 19 nt, Artificial Sequence
  siRNA sense sequence
cucuucagcaucgccugug

SEQ ID NO: 966 - RNA, 19 nt, Artificial Sequence
  siRNA antisense sequence
cacaggcgaugcugaagag

SEQ ID NO: 967 - RNA, 19 nt, Artificial Sequence
  siRNA sense sequence
cuucagcaucgccugugcc

SEQ ID NO: 968 - RNA, 19 nt, Artificial Sequence
  siRNA antisense sequence
ggcacaggcgaugcugaag

SEQ ID NO: 969 - RNA, 19 nt, Artificial Sequence
  siRNA sense sequence
uucagcaucgccugugccu

SEQ ID NO: 970 - RNA, 19 nt, Artificial Sequence
  siRNA antisense sequence
aggcacaggcgaugcugaa

SEQ ID NO: 971 - RNA, 19 nt, Artificial Sequence
  siRNA sense sequence
gcaucgccugugccuucuu

SEQ ID NO: 972 - RNA, 19 nt, Artificial Sequence
  siRNA antisense sequence
aagaaggcacaggcgaugc

SEQ ID NO: 973 - RNA, 19 nt, Artificial Sequence
  siRNA sense sequence
caucgccugugccuucuuc

SEQ ID NO: 974 - RNA, 19 nt, Artificial Sequence
  siRNA antisense sequence
gaagaaggcacaggcgaug

SEQ ID NO: 975 - RNA, 19 nt, Artificial Sequence
  siRNA sense sequence
aucgccugugccuucuucu

SEQ ID NO: 976 - RNA, 19 nt, Artificial Sequence
  siRNA antisense sequence
agaagaaggcacaggcgau

SEQ ID NO: 977 - RNA, 19 nt, Artificial Sequence
  siRNA sense sequence
ucgccugugccuucuucuu

SEQ ID NO: 978 - RNA, 19 nt, Artificial Sequence
  siRNA antisense sequence
aagaagaaggcacaggcga

SEQ ID NO: 979 - RNA, 19 nt, Artificial Sequence
  siRNA sense sequence
gccuucuucuuccucaccu

SEQ ID NO: 980 - RNA, 19 nt, Artificial Sequence
  siRNA antisense sequence
aggugaggaagaagaaggc

SEQ ID NO: 981 - RNA, 19 nt, Artificial Sequence
  siRNA sense sequence
ucuucuuccucaccugcuu

SEQ ID NO: 982 - RNA, 19 nt, Artificial Sequence
  siRNA antisense sequence
aagcaggugaggaagaaga

SEQ ID NO: 983 - RNA, 19 nt, Artificial Sequence
  siRNA sense sequence
cuucuuccucaccugcuuc

SEQ ID NO: 984 - RNA, 19 nt, Artificial Sequence
  siRNA antisense sequence
gaagcaggugaggaagaag

SEQ ID NO: 985 - RNA, 19 nt, Artificial Sequence
  siRNA sense sequence
cucaccugcuuccucaccc

SEQ ID NO: 986 - RNA, 19 nt, Artificial Sequence
  siRNA antisense sequence
gggugaggaagcaggugag

SEQ ID NO: 987 - RNA, 19 nt, Artificial Sequence
  siRNA sense sequence
ucaccugcuuccucacccg

SEQ ID NO: 988 - RNA, 19 nt, Artificial Sequence
  siRNA antisense sequence
cgggugaggaagcagguga

SEQ ID NO: 989 - RNA, 19 nt, Artificial Sequence
  siRNA sense sequence
accugcuuccucacccgga

SEQ ID NO: 990 - RNA, 19 nt, Artificial Sequence
  siRNA antisense sequence
uccgggugaggaagcaggu

SEQ ID NO: 991 - RNA, 19 nt, Artificial Sequence
  siRNA sense sequence
ugcuuccucacccggacca

SEQ ID NO: 992 - RNA, 19 nt, Artificial Sequence
  siRNA antisense sequence
ugguccgggugaggaagca

SEQ ID NO: 993 - RNA, 19 nt, Artificial Sequence
  siRNA sense sequence
ucuugguguggcaguggug

SEQ ID NO: 994 - RNA, 19 nt, Artificial Sequence
  siRNA antisense sequence
caccacugccacaccaaga

SEQ ID NO: 995 - RNA, 19 nt, Artificial Sequence
  siRNA sense sequence
uugguguggcagugguggu

SEQ ID NO: 996 - RNA, 19 nt, Artificial Sequence
  siRNA antisense sequence
accaccacugccacaccaa

SEQ ID NO: 997 - RNA, 19 nt, Artificial Sequence
  siRNA sense sequence
ugguguggcaguggugguc

SEQ ID NO: 998 - RNA, 19 nt, Artificial Sequence
  siRNA antisense sequence
gaccaccacugccacacca

SEQ ID NO: 999 - RNA, 19 nt, Artificial Sequence
  siRNA sense sequence
gguguggcagugguggucu

SEQ ID NO: 1000 - RNA, 19 nt, Artificial Sequence
  siRNA antisense sequence
agaccaccacugccacacc

SEQ ID NO: 1001 - RNA, 19 nt, Artificial Sequence
  siRNA sense sequence
guguggcagugguggucuu

SEQ ID NO: 1002 - RNA, 19 nt, Artificial Sequence
  siRNA antisense sequence
aagaccaccacugccacac

SEQ ID NO: 1003 - RNA, 19 nt, Artificial Sequence
  siRNA sense sequence
uguggcagugguggucuug

SEQ ID NO: 1004 - RNA, 19 nt, Artificial Sequence
  siRNA antisense sequence
caagaccaccacugccaca

SEQ ID NO: 1005 - RNA, 19 nt, Artificial Sequence
  siRNA sense sequence
guggcagugguggucuugg

SEQ ID NO: 1006 - RNA, 19 nt, Artificial Sequence
  siRNA antisense sequence
ccaagaccaccacugccac

SEQ ID NO: 1007 - RNA, 19 nt, Artificial Sequence
  siRNA sense sequence
uggcagugguggucuuggc

SEQ ID NO: 1008 - RNA, 19 nt, Artificial Sequence
  siRNA antisense sequence
gccaagaccaccacugcca

SEQ ID NO: 1009 - RNA, 19 nt, Artificial Sequence
  siRNA sense sequence
gcagugguggucuuggccu

SEQ ID NO: 1010 - RNA, 19 nt, Artificial Sequence
  siRNA antisense sequence
aggccaagaccaccacugc

SEQ ID NO: 1011 - RNA, 19 nt, Artificial Sequence
  siRNA sense sequence
cagugguggucuuggccuu

SEQ ID NO: 1012 - RNA, 19 nt, Artificial Sequence
  siRNA antisense sequence
aaggccaagaccaccacug

SEQ ID NO: 1013 - RNA, 19 nt, Artificial Sequence
  siRNA sense sequence
agugguggucuuggccuug

SEQ ID NO: 1014 - RNA, 19 nt, Artificial Sequence
  siRNA antisense sequence
caaggccaagaccaccacu

SEQ ID NO: 1015 - RNA, 19 nt, Artificial Sequence
  siRNA sense sequence
gugguggucuuggccuugg

SEQ ID NO: 1016 - RNA, 19 nt, Artificial Sequence
  siRNA antisense sequence
ccaaggccaagaccaccac

SEQ ID NO: 1017 - RNA, 19 nt, Artificial Sequence
  siRNA sense sequence
ugguggucuuggccuuggg

SEQ ID NO: 1018 - RNA, 19 nt, Artificial Sequence
  siRNA antisense sequence
cccaaggccaagaccacca

SEQ ID NO: 1019 - RNA, 19 nt, Artificial Sequence
  siRNA sense sequence
guugcugcuggugcugagc

SEQ ID NO: 1020 - RNA, 19 nt, Artificial Sequence
  siRNA antisense sequence
gcucagcaccagcagcaac

SEQ ID NO: 1021 - RNA, 19 nt, Artificial Sequence
  siRNA sense sequence
uugcugcuggugcugagcu

SEQ ID NO: 1022 - RNA, 19 nt, Artificial Sequence
  siRNA antisense sequence
agcucagcaccagcagcaa

SEQ ID NO: 1023 - RNA, 19 nt, Artificial Sequence
  siRNA sense sequence
ugcugcuggugcugagcug

SEQ ID NO: 1024 - RNA, 19 nt, Artificial Sequence
  siRNA antisense sequence
cagcucagcaccagcagca

SEQ ID NO: 1025 - RNA, 19 nt, Artificial Sequence
  siRNA sense sequence
ugcuggugcugagcugcgu

SEQ ID NO: 1026 - RNA, 19 nt, Artificial Sequence
  siRNA antisense sequence
acgcagcucagcaccagca

SEQ ID NO: 1027 - RNA, 19 nt, Artificial Sequence
  siRNA sense sequence
gcuggugcugagcugcgua

SEQ ID NO: 1028 - RNA, 19 nt, Artificial Sequence
  siRNA antisense sequence
uacgcagcucagcaccagc

SEQ ID NO: 1029 - RNA, 19 nt, Artificial Sequence
  siRNA sense sequence
cuggugcugagcugcguag

SEQ ID NO: 1030 - RNA, 19 nt, Artificial Sequence
  siRNA antisense sequence
cuacgcagcucagcaccag

SEQ ID NO: 1031 - RNA, 19 nt, Artificial Sequence
  siRNA sense sequence
uggugcugagcugcguagg

SEQ ID NO: 1032 - RNA, 19 nt, Artificial Sequence
  siRNA antisense sequence
ccuacgcagcucagcacca

SEQ ID NO: 1033 - RNA, 19 nt, Artificial Sequence
  siRNA sense sequence
uagggcugcugcugacgcu

SEQ ID NO: 1034 - RNA, 19 nt, Artificial Sequence
  siRNA antisense sequence
agcgucagcagcagcccua

SEQ ID NO: 1035 - RNA, 19 nt, Artificial Sequence
  siRNA sense sequence
uccggcacugcguucuggu

SEQ ID NO: 1036 - RNA, 19 nt, Artificial Sequence
  siRNA antisense sequence
accagaacgcagugccgga

SEQ ID NO: 1037 - RNA, 19 nt, Artificial Sequence
  siRNA sense sequence
ugcuccuggccagcuucgu

SEQ ID NO: 1038 - RNA, 19 nt, Artificial Sequence
  siRNA antisense sequence
acgaagcuggccaggagca

SEQ ID NO: 1039 - RNA, 19 nt, Artificial Sequence
  siRNA sense sequence
cuccuggccagcuucgucu

SEQ ID NO: 1040 - RNA, 19 nt, Artificial Sequence
  siRNA antisense sequence
agacgaagcuggccaggag

SEQ ID NO: 1041 - RNA, 19 nt, Artificial Sequence
  siRNA sense sequence
uccuggccagcuucgucug

SEQ ID NO: 1042 - RNA, 19 nt, Artificial Sequence
  siRNA antisense sequence
cagacgaagcuggccagga

SEQ ID NO: 1043 - RNA, 19 nt, Artificial Sequence
  siRNA sense sequence
cagcuucgucugguggguc

SEQ ID NO: 1044 - RNA, 19 nt, Artificial Sequence
  siRNA antisense sequence
gacccaccagacgaagcug

SEQ ID NO: 1045 - RNA, 19 nt, Artificial Sequence
  siRNA sense sequence
agcuucgucuggugggucu

SEQ ID NO: 1046 - RNA, 19 nt, Artificial Sequence
  siRNA antisense sequence
agacccaccagacgaagcu

SEQ ID NO: 1047 - RNA, 19 nt, Artificial Sequence
  siRNA sense sequence
gcuucgucuggugggucuc

SEQ ID NO: 1048 - RNA, 19 nt, Artificial Sequence
  siRNA antisense sequence
gagacccaccagacgaagc

SEQ ID NO: 1049 - RNA, 19 nt, Artificial Sequence
  siRNA sense sequence
gucuggugggucuccuuca

SEQ ID NO: 1050 - RNA, 19 nt, Artificial Sequence
  siRNA antisense sequence
ugaaggagacccaccagac

SEQ ID NO: 1051 - RNA, 19 nt, Artificial Sequence
  siRNA sense sequence
ucuggugggucuccuucac

SEQ ID NO: 1052 - RNA, 19 nt, Artificial Sequence
  siRNA antisense sequence
gugaaggagacccaccaga

SEQ ID NO: 1053 - RNA, 19 nt, Artificial Sequence
  siRNA sense sequence
uccuucaccagccucgggu

SEQ ID NO: 1054 - RNA, 19 nt, Artificial Sequence
  siRNA antisense sequence
acccgaggcuggugaagga

SEQ ID NO: 1055 - RNA, 19 nt, Artificial Sequence
  siRNA sense sequence
uggaucacuucuuucaaau

SEQ ID NO: 1056 - RNA, 19 nt, Artificial Sequence
  siRNA antisense sequence
auuugaaagaagugaucca

SEQ ID NO: 1057 - RNA, 19 nt, Artificial Sequence
  siRNA sense sequence
ggaucacuucuuucaaauc

SEQ ID NO: 1058 - RNA, 19 nt, Artificial Sequence
  siRNA antisense sequence
gauuugaaagaagugaucc

SEQ ID NO: 1059 - RNA, 19 nt, Artificial Sequence
  siRNA sense sequence
gaucacuucuuucaaauca

SEQ ID NO: 1060 - RNA, 19 nt, Artificial Sequence
  siRNA antisense sequence
ugauuugaaagaagugauc

SEQ ID NO: 1061 - RNA, 19 nt, Artificial Sequence
  siRNA sense sequence
uucuuucaaaucagggaag

SEQ ID NO: 1062 - RNA, 19 nt, Artificial Sequence
  siRNA antisense sequence
cuucccugauuugaaagaa

SEQ ID NO: 1063 - RNA, 19 nt, Artificial Sequence
  siRNA sense sequence
ucuuucaaaucagggaagc

SEQ ID NO: 1064 - RNA, 19 nt, Artificial Sequence
  siRNA antisense sequence
gcuucccugauuugaaaga

SEQ ID NO: 1065 - RNA, 19 nt, Artificial Sequence
  siRNA sense sequence
cuuucaaaucagggaagcg

SEQ ID NO: 1066 - RNA, 19 nt, Artificial Sequence
  siRNA antisense sequence
cgcuucccugauuugaaag

SEQ ID NO: 1067 - RNA, 19 nt, Artificial Sequence
  siRNA sense sequence
uuucaaaucagggaagcgc

SEQ ID NO: 1068 - RNA, 19 nt, Artificial Sequence
  siRNA antisense sequence
gcgcuucccugauuugaaa

SEQ ID NO: 1069 - RNA, 19 nt, Artificial Sequence
  siRNA sense sequence
uucaaaucagggaagcgcc

SEQ ID NO: 1070 - RNA, 19 nt, Artificial Sequence
  siRNA antisense sequence
ggcgcuucccugauuugaa

SEQ ID NO: 1071 - RNA, 19 nt, Artificial Sequence
  siRNA sense sequence
ucaaaucagggaagcgccu

SEQ ID NO: 1072 - RNA, 19 nt, Artificial Sequence
  siRNA antisense sequence
aggcgcuucccugauuuga

SEQ ID NO: 1073 - RNA, 19 nt, Artificial Sequence
  siRNA sense sequence
caaaucagggaagcgccuc

SEQ ID NO: 1074 - RNA, 19 nt, Artificial Sequence
  siRNA antisense sequence
gaggcgcuucccugauuug

SEQ ID NO: 1075 - RNA, 19 nt, Artificial Sequence
  siRNA sense sequence
aaaucagggaagcgccucu

SEQ ID NO: 1076 - RNA, 19 nt, Artificial Sequence
  siRNA antisense sequence
agaggcgcuucccugauuu

SEQ ID NO: 1077 - RNA, 19 nt, Artificial Sequence
  siRNA sense sequence
aaucagggaagcgccucuu

SEQ ID NO: 1078 - RNA, 19 nt, Artificial Sequence
  siRNA antisense sequence
aagaggcgcuucccugauu

SEQ ID NO: 1079 - RNA, 19 nt, Artificial Sequence
  siRNA sense sequence
cgccucuucauccucgacu

SEQ ID NO: 1080 - RNA, 19 nt, Artificial Sequence
  siRNA antisense sequence
agucgaggaugaagaggcg

SEQ ID NO: 1081 - RNA, 19 nt, Artificial Sequence
  siRNA sense sequence
gccucuucauccucgacug

SEQ ID NO: 1082 - RNA, 19 nt, Artificial Sequence
  siRNA antisense sequence
cagucgaggaugaagaggc

SEQ ID NO: 1083 - RNA, 19 nt, Artificial Sequence
  siRNA sense sequence
ccucuucauccucgacugu

SEQ ID NO: 1084 - RNA, 19 nt, Artificial Sequence
  siRNA antisense sequence
acagucgaggaugaagagg

SEQ ID NO: 1085 - RNA, 19 nt, Artificial Sequence
  siRNA sense sequence
cucuucauccucgacuguc

SEQ ID NO: 1086 - RNA, 19 nt, Artificial Sequence
  siRNA antisense sequence
gacagucgaggaugaagag

SEQ ID NO: 1087 - RNA, 19 nt, Artificial Sequence
  siRNA sense sequence
ucuucauccucgacugucc

SEQ ID NO: 1088 - RNA, 19 nt, Artificial Sequence
  siRNA antisense sequence
ggacagucgaggaugaaga

SEQ ID NO: 1089 - RNA, 19 nt, Artificial Sequence
  siRNA sense sequence
cuucauccucgacugucca

SEQ ID NO: 1090 - RNA, 19 nt, Artificial Sequence
  siRNA antisense sequence
uggacagucgaggaugaag

SEQ ID NO: 1091 - RNA, 19 nt, Artificial Sequence
  siRNA sense sequence
auccucgacuguccagugc

SEQ ID NO: 1092 - RNA, 19 nt, Artificial Sequence
  siRNA antisense sequence
gcacuggacagucgaggau

SEQ ID NO: 1093 - RNA, 19 nt, Artificial Sequence
  siRNA sense sequence
uccucgacuguccagugcc

SEQ ID NO: 1094 - RNA, 19 nt, Artificial Sequence
  siRNA antisense sequence
ggcacuggacagucgagga

SEQ ID NO: 1095 - RNA, 19 nt, Artificial Sequence
  siRNA sense sequence
aagugccugugauccgacc

SEQ ID NO: 1096 - RNA, 19 nt, Artificial Sequence
  siRNA antisense sequence
ggucggaucacaggcacuu

SEQ ID NO: 1097 - RNA, 19 nt, Artificial Sequence
  siRNA sense sequence
agugccugugauccgaccc

SEQ ID NO: 1098 - RNA, 19 nt, Artificial Sequence
  siRNA antisense sequence
gggucggaucacaggcacu

SEQ ID NO: 1099 - RNA, 19 nt, Artificial Sequence
  siRNA sense sequence
aggagguccagcugcgugu

SEQ ID NO: 1100 - RNA, 19 nt, Artificial Sequence
  siRNA antisense sequence
acacgcagcuggaccuccu

SEQ ID NO: 1101 - RNA, 19 nt, Artificial Sequence
  siRNA sense sequence
agguccagcugcgugucgu

SEQ ID NO: 1102 - RNA, 19 nt, Artificial Sequence
  siRNA antisense sequence
acgacacgcagcuggaccu

SEQ ID NO: 1103 - RNA, 19 nt, Artificial Sequence
  siRNA sense sequence
gguccagcugcgugucguu

SEQ ID NO: 1104 - RNA, 19 nt, Artificial Sequence
  siRNA antisense sequence
aacgacacgcagcuggacc

SEQ ID NO: 1105 - RNA, 19 nt, Artificial Sequence
  siRNA sense sequence
guccagcugcgugucguua

SEQ ID NO: 1106 - RNA, 19 nt, Artificial Sequence
  siRNA antisense sequence
uaacgacacgcagcuggac

SEQ ID NO: 1107 - RNA, 19 nt, Artificial Sequence
  siRNA sense sequence
uccagcugcgugucguuag

SEQ ID NO: 1108 - RNA, 19 nt, Artificial Sequence
  siRNA antisense sequence
cuaacgacacgcagcugga

SEQ ID NO: 1109 - RNA, 19 nt, Artificial Sequence
  siRNA sense sequence
ccagcugcgugucguuagg

SEQ ID NO: 1110 - RNA, 19 nt, Artificial Sequence
  siRNA antisense sequence
ccuaacgacacgcagcugg

SEQ ID NO: 1111 - RNA, 19 nt, Artificial Sequence
  siRNA sense sequence
cagcugcgugucguuagga

SEQ ID NO: 1112 - RNA, 19 nt, Artificial Sequence
  siRNA antisense sequence
uccuaacgacacgcagcug

SEQ ID NO: 1113 - RNA, 19 nt, Artificial Sequence
  siRNA sense sequence
agcugcgugucguuaggag

SEQ ID NO: 1114 - RNA, 19 nt, Artificial Sequence
  siRNA antisense sequence
cuccuaacgacacgcagcu

SEQ ID NO: 1115 - RNA, 19 nt, Artificial Sequence
  siRNA sense sequence
cugcagccaguuacuaugg

SEQ ID NO: 1116 - RNA, 19 nt, Artificial Sequence
  siRNA antisense sequence
ccauaguaacuggcugcag

SEQ ID NO: 1117 - RNA, 19 nt, Artificial Sequence
  siRNA sense sequence
ccaguuacuauggcaguug

SEQ ID NO: 1118 - RNA, 19 nt, Artificial Sequence
  siRNA antisense sequence
caacugccauaguaacugg

SEQ ID NO: 1119 - RNA, 19 nt, Artificial Sequence
  siRNA sense sequence
caguuacuauggcaguugc

SEQ ID NO: 1120 - RNA, 19 nt, Artificial Sequence
  siRNA antisense sequence
gcaacugccauaguaacug

SEQ ID NO: 1121 - RNA, 19 nt, Artificial Sequence
  siRNA sense sequence
aguuacuauggcaguugca

SEQ ID NO: 1122 - RNA, 19 nt, Artificial Sequence
  siRNA antisense sequence
ugcaacugccauaguaacu

SEQ ID NO: 1123 - RNA, 19 nt, Artificial Sequence
  siRNA sense sequence
guuacuauggcaguugcaa

SEQ ID NO: 1124 - RNA, 19 nt, Artificial Sequence
  siRNA antisense sequence
uugcaacugccauaguaac

SEQ ID NO: 1125 - RNA, 19 nt, Artificial Sequence
  siRNA sense sequence
uuacuauggcaguugcaaa

SEQ ID NO: 1126 - RNA, 19 nt, Artificial Sequence
  siRNA antisense sequence
uuugcaacugccauaguaa

SEQ ID NO: 1127 - RNA, 19 nt, Artificial Sequence
  siRNA sense sequence
uacuauggcaguugcaaaa

SEQ ID NO: 1128 - RNA, 19 nt, Artificial Sequence
  siRNA antisense sequence
uuuugcaacugccauagua

SEQ ID NO: 1129 - RNA, 19 nt, Artificial Sequence
  siRNA sense sequence
acuauggcaguugcaaaau

SEQ ID NO: 1130 - RNA, 19 nt, Artificial Sequence
  siRNA antisense sequence
auuuugcaacugccauagu

SEQ ID NO: 1131 - RNA, 19 nt, Artificial Sequence
  siRNA sense sequence
cuauggcaguugcaaaaua

SEQ ID NO: 1132 - RNA, 19 nt, Artificial Sequence
  siRNA antisense sequence
uauuuugcaacugccauag

SEQ ID NO: 1133 - RNA, 19 nt, Artificial Sequence
  siRNA sense sequence
uauggcaguugcaaaauau

SEQ ID NO: 1134 - RNA, 19 nt, Artificial Sequence
  siRNA antisense sequence
auauuuugcaacugccaua

SEQ ID NO: 1135 - RNA, 19 nt, Artificial Sequence
  siRNA sense sequence
uggcaguugcaaaauauuc

SEQ ID NO: 1136 - RNA, 19 nt, Artificial Sequence
  siRNA antisense sequence
gaauauuuugcaacugcca

SEQ ID NO: 1137 - RNA, 19 nt, Artificial Sequence
  siRNA sense sequence
ggcaguugcaaaauauuca

SEQ ID NO: 1138 - RNA, 19 nt, Artificial Sequence
  siRNA antisense sequence
ugaauauuuugcaacugcc

SEQ ID NO: 1139 - RNA, 19 nt, Artificial Sequence
  siRNA sense sequence
caguugcaaaauauucagg

SEQ ID NO: 1140 - RNA, 19 nt, Artificial Sequence
  siRNA antisense sequence
ccugaauauuuugcaacug

SEQ ID NO: 1141 - RNA, 19 nt, Artificial Sequence
  siRNA sense sequence
agaccgucguugccuugua

SEQ ID NO: 1142 - RNA, 19 nt, Artificial Sequence
  siRNA antisense sequence
uacaaggcaacgacggucu

SEQ ID NO: 1143 - RNA, 19 nt, Artificial Sequence
  siRNA sense sequence
cgucguugccuuguauuuc

SEQ ID NO: 1144 - RNA, 19 nt, Artificial Sequence
  siRNA antisense sequence
gaaauacaaggcaacgacg

SEQ ID NO: 1145 - RNA, 19 nt, Artificial Sequence
  siRNA sense sequence
gucguugccuuguauuucc

SEQ ID NO: 1146 - RNA, 19 nt, Artificial Sequence
  siRNA antisense sequence
ggaaauacaaggcaacgac

SEQ ID NO: 1147 - RNA, 19 nt, Artificial Sequence
  siRNA sense sequence
ucguugccuuguauuucca

SEQ ID NO: 1148 - RNA, 19 nt, Artificial Sequence
  siRNA antisense sequence
uggaaauacaaggcaacga

SEQ ID NO: 1149 - RNA, 19 nt, Artificial Sequence
  siRNA sense sequence
cguugccuuguauuuccag

SEQ ID NO: 1150 - RNA, 19 nt, Artificial Sequence
  siRNA antisense sequence
cuggaaauacaaggcaacg

SEQ ID NO: 1151 - RNA, 19 nt, Artificial Sequence
  siRNA sense sequence
guugccuuguauuuccaga

SEQ ID NO: 1152 - RNA, 19 nt, Artificial Sequence
  siRNA antisense sequence
ucuggaaauacaaggcaac

SEQ ID NO: 1153 - RNA, 19 nt, Artificial Sequence
  siRNA sense sequence
acagaugauucuuugggau

SEQ ID NO: 1154 - RNA, 19 nt, Artificial Sequence
  siRNA antisense sequence
aucccaaagaaucaucugu

SEQ ID NO: 1155 - RNA, 19 nt, Artificial Sequence
  siRNA sense sequence
cagaugauucuuugggauu

SEQ ID NO: 1156 - RNA, 19 nt, Artificial Sequence
  siRNA antisense sequence
aaucccaaagaaucaucug

SEQ ID NO: 1157 - RNA, 19 nt, Artificial Sequence
  siRNA sense sequence
agaugauucuuugggauug

SEQ ID NO: 1158 - RNA, 19 nt, Artificial Sequence
  siRNA antisense sequence
caaucccaaagaaucaucu

SEQ ID NO: 1159 - RNA, 19 nt, Artificial Sequence
  siRNA sense sequence
gaugauucuuugggauugg

SEQ ID NO: 1160 - RNA, 19 nt, Artificial Sequence
  siRNA antisense sequence
ccaaucccaaagaaucauc

SEQ ID NO: 1161 - RNA, 19 nt, Artificial Sequence
  siRNA sense sequence
augauucuuugggauuggg

SEQ ID NO: 1162 - RNA, 19 nt, Artificial Sequence
  siRNA antisense sequence
cccaaucccaaagaaucau

SEQ ID NO: 1163 - RNA, 19 nt, Artificial Sequence
  siRNA sense sequence
ugauucuuugggauuggga

SEQ ID NO: 1164 - RNA, 19 nt, Artificial Sequence
  siRNA antisense sequence
ucccaaucccaaagaauca

SEQ ID NO: 1165 - RNA, 19 nt, Artificial Sequence
  siRNA sense sequence
gauucuuugggauugggac

SEQ ID NO: 1166 - RNA, 19 nt, Artificial Sequence
  siRNA antisense sequence
gucccaaucccaaagaauc

SEQ ID NO: 1167 - RNA, 19 nt, Artificial Sequence
  siRNA sense sequence
auucuuugggauugggacu

SEQ ID NO: 1168 - RNA, 19 nt, Artificial Sequence
  siRNA antisense sequence
agucccaaucccaaagaau

SEQ ID NO: 1169 - RNA, 19 nt, Artificial Sequence
  siRNA sense sequence
uucuuugggauugggacuu

SEQ ID NO: 1170 - RNA, 19 nt, Artificial Sequence
  siRNA antisense sequence
aagucccaaucccaaagaa

SEQ ID NO: 1171 - RNA, 19 nt, Artificial Sequence
  siRNA sense sequence
ucuuugggauugggacuua

SEQ ID NO: 1172 - RNA, 19 nt, Artificial Sequence
  siRNA antisense sequence
uaagucccaaucccaaaga

SEQ ID NO: 1173 - RNA, 19 nt, Artificial Sequence
  siRNA sense sequence
uuugggauugggacuuaaa

SEQ ID NO: 1174 - RNA, 19 nt, Artificial Sequence
  siRNA antisense sequence
uuuaagucccaaucccaaa

SEQ ID NO: 1175 - RNA, 19 nt, Artificial Sequence
  siRNA sense sequence
uugggauugggacuuaaaa

SEQ ID NO: 1176 - RNA, 19 nt, Artificial Sequence
  siRNA antisense sequence
uuuuaagucccaaucccaa

SEQ ID NO: 1177 - RNA, 19 nt, Artificial Sequence
  siRNA sense sequence
agccucauuaucaaaauuc

SEQ ID NO: 1178 - RNA, 19 nt, Artificial Sequence
  siRNA antisense sequence
gaauuuugauaaugaggcu

SEQ ID NO: 1179 - RNA, 19 nt, Artificial Sequence
  siRNA sense sequence
gccucauuaucaaaauucu

SEQ ID NO: 1180 - RNA, 19 nt, Artificial Sequence
  siRNA antisense sequence
agaauuuugauaaugaggc

SEQ ID NO: 1181 - RNA, 19 nt, Artificial Sequence
  siRNA sense sequence
ccucauuaucaaaauucug

SEQ ID NO: 1182 - RNA, 19 nt, Artificial Sequence
  siRNA antisense sequence
cagaauuuugauaaugagg

SEQ ID NO: 1183 - RNA, 19 nt, Artificial Sequence
  siRNA sense sequence
cucauuaucaaaauucugg

SEQ ID NO: 1184 - RNA, 19 nt, Artificial Sequence
  siRNA antisense sequence
ccagaauuuugauaaugag

SEQ ID NO: 1185 - RNA, 19 nt, Artificial Sequence
  siRNA sense sequence
cauuaucaaaauucuggag

SEQ ID NO: 1186 - RNA, 19 nt, Artificial Sequence
  siRNA antisense sequence
cuccagaauuuugauaaug

SEQ ID NO: 1187 - RNA, 19 nt, Artificial Sequence
  siRNA sense sequence
auuaucaaaauucuggagg

SEQ ID NO: 1188 - RNA, 19 nt, Artificial Sequence
  siRNA antisense sequence
ccuccagaauuuugauaau

SEQ ID NO: 1189 - RNA, 19 nt, Artificial Sequence
  siRNA sense sequence
uuaucaaaauucuggaggu

SEQ ID NO: 1190 - RNA, 19 nt, Artificial Sequence
  siRNA antisense sequence
accuccagaauuuugauaa

SEQ ID NO: 1191 - RNA, 19 nt, Artificial Sequence
  siRNA sense sequence
uaucaaaauucuggaggug

SEQ ID NO: 1192 - RNA, 19 nt, Artificial Sequence
  siRNA antisense sequence
caccuccagaauuuugaua

SEQ ID NO: 1193 - RNA, 19 nt, Artificial Sequence
  siRNA sense sequence
aucaaaauucuggaggugg

SEQ ID NO: 1194 - RNA, 19 nt, Artificial Sequence
  siRNA antisense sequence
ccaccuccagaauuuugau

SEQ ID NO: 1195 - RNA, 19 nt, Artificial Sequence
  siRNA sense sequence
ucaaaauucuggaggugga

SEQ ID NO: 1196 - RNA, 19 nt, Artificial Sequence
  siRNA antisense sequence
uccaccuccagaauuuuga

SEQ ID NO: 1197 - RNA, 19 nt, Artificial Sequence
  siRNA sense sequence
caaaauucuggagguggaa

SEQ ID NO: 1198 - RNA, 19 nt, Artificial Sequence
  siRNA antisense sequence
uuccaccuccagaauuuug

SEQ ID NO: 1199 - RNA, 19 nt, Artificial Sequence
  siRNA sense sequence
uggaguugaucuuucagug

SEQ ID NO: 1200 - RNA, 19 nt, Artificial Sequence
  siRNA antisense sequence
cacugaaagaucaacucca

SEQ ID NO: 1201 - RNA, 19 nt, Artificial Sequence
  siRNA sense sequence
ggaguugaucuuucagugc

SEQ ID NO: 1202 - RNA, 19 nt, Artificial Sequence
  siRNA antisense sequence
gcacugaaagaucaacucc

SEQ ID NO: 1203 - RNA, 19 nt, Artificial Sequence
  siRNA sense sequence
gaguugaucuuucagugcu

SEQ ID NO: 1204 - RNA, 19 nt, Artificial Sequence
  siRNA antisense sequence
agcacugaaagaucaacuc

SEQ ID NO: 1205 - RNA, 19 nt, Artificial Sequence
  siRNA sense sequence
aguugaucuuucagugcua

SEQ ID NO: 1206 - RNA, 19 nt, Artificial Sequence
  siRNA antisense sequence
uagcacugaaagaucaacu

SEQ ID NO: 1207 - RNA, 19 nt, Artificial Sequence
  siRNA sense sequence
guugaucuuucagugcuaa

SEQ ID NO: 1208 - RNA, 19 nt, Artificial Sequence
  siRNA antisense sequence
uuagcacugaaagaucaac

SEQ ID NO: 1209 - RNA, 19 nt, Artificial Sequence
  siRNA sense sequence
uugaucuuucagugcuaaa

SEQ ID NO: 1210 - RNA, 19 nt, Artificial Sequence
  siRNA antisense sequence
uuuagcacugaaagaucaa

SEQ ID NO: 1211 - RNA, 19 nt, Artificial Sequence
  siRNA sense sequence
ugaucuuucagugcuaaau

SEQ ID NO: 1212 - RNA, 19 nt, Artificial Sequence
  siRNA antisense sequence
auuuagcacugaaagauca

SEQ ID NO: 1213 - RNA, 19 nt, Artificial Sequence
  siRNA sense sequence
gaucuuucagugcuaaaug

SEQ ID NO: 1214 - RNA, 19 nt, Artificial Sequence
  siRNA antisense sequence
cauuuagcacugaaagauc

SEQ ID NO: 1215 - RNA, 19 nt, Artificial Sequence
  siRNA sense sequence
uuucagugcuaaaugaggc

SEQ ID NO: 1216 - RNA, 19 nt, Artificial Sequence
  siRNA antisense sequence
gccucauuuagcacugaaa

SEQ ID NO: 1217 - RNA, 19 nt, Artificial Sequence
  siRNA sense sequence
uucagugcuaaaugaggcu

SEQ ID NO: 1218 - RNA, 19 nt, Artificial Sequence
  siRNA antisense sequence
agccucauuuagcacugaa

SEQ ID NO: 1219 - RNA, 19 nt, Artificial Sequence
  siRNA sense sequence
ucagugcuaaaugaggcuc

SEQ ID NO: 1220 - RNA, 19 nt, Artificial Sequence
  siRNA antisense sequence
gagccucauuuagcacuga

SEQ ID NO: 1221 - RNA, 19 nt, Artificial Sequence
  siRNA sense sequence
cagugcuaaaugaggcucg

SEQ ID NO: 1222 - RNA, 19 nt, Artificial Sequence
  siRNA antisense sequence
cgagccucauuuagcacug

SEQ ID NO: 1223 - RNA, 19 nt, Artificial Sequence
  siRNA sense sequence
agugcuaaaugaggcucgc

SEQ ID NO: 1224 - RNA, 19 nt, Artificial Sequence
  siRNA antisense sequence
gcgagccucauuuagcacu

SEQ ID NO: 1225 - RNA, 19 nt, Artificial Sequence
  siRNA sense sequence
gugcuaaaugaggcucgca

SEQ ID NO: 1226 - RNA, 19 nt, Artificial Sequence
  siRNA antisense sequence
ugcgagccucauuuagcac

SEQ ID NO: 1227 - RNA, 19 nt, Artificial Sequence
  siRNA sense sequence
ugcuaaaugaggcucgcaa

SEQ ID NO: 1228 - RNA, 19 nt, Artificial Sequence
  siRNA antisense sequence
uugcgagccucauuuagca

SEQ ID NO: 1229 - RNA, 19 nt, Artificial Sequence
  siRNA sense sequence
gcuaaaugaggcucgcaau

SEQ ID NO: 1230 - RNA, 19 nt, Artificial Sequence
  siRNA antisense sequence
auugcgagccucauuuagc

SEQ ID NO: 1231 - RNA, 19 nt, Artificial Sequence
  siRNA sense sequence
aaugaggcucgcaauaugg

SEQ ID NO: 1232 - RNA, 19 nt, Artificial Sequence
  siRNA antisense sequence
ccauauugcgagccucauu

SEQ ID NO: 1233 - RNA, 19 nt, Artificial Sequence
  siRNA sense sequence
augaggcucgcaauauggu

SEQ ID NO: 1234 - RNA, 19 nt, Artificial Sequence
  siRNA antisense sequence
accauauugcgagccucau

SEQ ID NO: 1235 - RNA, 19 nt, Artificial Sequence
  siRNA sense sequence
ugaggcucgcaauauggug

SEQ ID NO: 1236 - RNA, 19 nt, Artificial Sequence
  siRNA antisense sequence
caccauauugcgagccuca

SEQ ID NO: 1237 - RNA, 19 nt, Artificial Sequence
  siRNA sense sequence
gaggcucgcaauauggugu

SEQ ID NO: 1238 - RNA, 19 nt, Artificial Sequence
  siRNA antisense sequence
acaccauauugcgagccuc

SEQ ID NO: 1239 - RNA, 19 nt, Artificial Sequence
  siRNA sense sequence
aggcucgcaauaugguguc

SEQ ID NO: 1240 - RNA, 19 nt, Artificial Sequence
  siRNA antisense sequence
gacaccauauugcgagccu

SEQ ID NO: 1241 - RNA, 19 nt, Artificial Sequence
  siRNA sense sequence
ggcucgcaauaugguguca

SEQ ID NO: 1242 - RNA, 19 nt, Artificial Sequence
  siRNA antisense sequence
ugacaccauauugcgagcc

SEQ ID NO: 1243 - RNA, 19 nt, Artificial Sequence
  siRNA sense sequence
gcucgcaauauggugucag

SEQ ID NO: 1244 - RNA, 19 nt, Artificial Sequence
  siRNA antisense sequence
cugacaccauauugcgagc

SEQ ID NO: 1245 - RNA, 19 nt, Artificial Sequence
  siRNA sense sequence
cucgcaauauggugucaga

SEQ ID NO: 1246 - RNA, 19 nt, Artificial Sequence
  siRNA antisense sequence
ucugacaccauauugcgag

SEQ ID NO: 1247 - RNA, 19 nt, Artificial Sequence
  siRNA sense sequence
ucgcaauauggugucagau

SEQ ID NO: 1248 - RNA, 19 nt, Artificial Sequence
  siRNA antisense sequence
aucugacaccauauugcga

SEQ ID NO: 1249 - RNA, 19 nt, Artificial Sequence
  siRNA sense sequence
cgcaauauggugucagauc

SEQ ID NO: 1250 - RNA, 19 nt, Artificial Sequence
  siRNA antisense sequence
gaucugacaccauauugcg

SEQ ID NO: 1251 - RNA, 19 nt, Artificial Sequence
  siRNA sense sequence
gcaauauggugucagaucu

SEQ ID NO: 1252 - RNA, 19 nt, Artificial Sequence
  siRNA antisense sequence
agaucugacaccauauugc

SEQ ID NO: 1253 - RNA, 19 nt, Artificial Sequence
  siRNA sense sequence
caauauggugucagaucuu

SEQ ID NO: 1254 - RNA, 19 nt, Artificial Sequence
  siRNA antisense sequence
aagaucugacaccauauug

SEQ ID NO: 1255 - RNA, 19 nt, Artificial Sequence
  siRNA sense sequence
aauauggugucagaucuuc

SEQ ID NO: 1256 - RNA, 19 nt, Artificial Sequence
  siRNA antisense sequence
gaagaucugacaccauauu

SEQ ID NO: 1257 - RNA, 19 nt, Artificial Sequence
  siRNA sense sequence
auauggugucagaucuucu

SEQ ID NO: 1258 - RNA, 19 nt, Artificial Sequence
  siRNA antisense sequence
agaagaucugacaccauau

SEQ ID NO: 1259 - RNA, 19 nt, Artificial Sequence
  siRNA sense sequence
aucuucugacugauccaag

SEQ ID NO: 1260 - RNA, 19 nt, Artificial Sequence
  siRNA antisense sequence
cuuggaucagucagaagau

SEQ ID NO: 1261 - RNA, 19 nt, Artificial Sequence
  siRNA sense sequence
ucuucugacugauccaagc

SEQ ID NO: 1262 - RNA, 19 nt, Artificial Sequence
  siRNA antisense sequence
gcuuggaucagucagaaga

SEQ ID NO: 1263 - RNA, 19 nt, Artificial Sequence
  siRNA sense sequence
cuucugacugauccaagcc

SEQ ID NO: 1264 - RNA, 19 nt, Artificial Sequence
  siRNA antisense sequence
ggcuuggaucagucagaag

SEQ ID NO: 1265 - RNA, 19 nt, Artificial Sequence
  siRNA sense sequence
uucugacugauccaagccu

SEQ ID NO: 1266 - RNA, 19 nt, Artificial Sequence
  siRNA antisense sequence
aggcuuggaucagucagaa

SEQ ID NO: 1267 - RNA, 19 nt, Artificial Sequence
  siRNA sense sequence
ucugacugauccaagccuu

SEQ ID NO: 1268 - RNA, 19 nt, Artificial Sequence
  siRNA antisense sequence
aaggcuuggaucagucaga

SEQ ID NO: 1269 - RNA, 19 nt, Artificial Sequence
  siRNA sense sequence
cugacugauccaagccuuc

SEQ ID NO: 1270 - RNA, 19 nt, Artificial Sequence
  siRNA antisense sequence
gaaggcuuggaucagucag

SEQ ID NO: 1271 - RNA, 19 nt, Artificial Sequence
  siRNA sense sequence
ugacugauccaagccuucc

SEQ ID NO: 1272 - RNA, 19 nt, Artificial Sequence
  siRNA antisense sequence
ggaaggcuuggaucaguca

SEQ ID NO: 1273 - RNA, 19 nt, Artificial Sequence
  siRNA sense sequence
gacugauccaagccuucca

SEQ ID NO: 1274 - RNA, 19 nt, Artificial Sequence
  siRNA antisense sequence
uggaaggcuuggaucaguc

SEQ ID NO: 1275 - RNA, 19 nt, Artificial Sequence
  siRNA sense sequence
acugauccaagccuuccac

SEQ ID NO: 1276 - RNA, 19 nt, Artificial Sequence
  siRNA antisense sequence
guggaaggcuuggaucagu

SEQ ID NO: 1277 - RNA, 19 nt, Artificial Sequence
  siRNA sense sequence
cugauccaagccuuccacc

SEQ ID NO: 1278 - RNA, 19 nt, Artificial Sequence
  siRNA antisense sequence
gguggaaggcuuggaucag

SEQ ID NO: 1279 - RNA, 19 nt, Artificial Sequence
  siRNA sense sequence
ugauccaagccuuccacca

SEQ ID NO: 1280 - RNA, 19 nt, Artificial Sequence
  siRNA antisense sequence
ugguggaaggcuuggauca

SEQ ID NO: 1281 - RNA, 19 nt, Artificial Sequence
  siRNA sense sequence
gauccaagccuuccaccac

SEQ ID NO: 1282 - RNA, 19 nt, Artificial Sequence
  siRNA antisense sequence
gugguggaaggcuuggauc

SEQ ID NO: 1283 - RNA, 19 nt, Artificial Sequence
  siRNA sense sequence
auccaagccuuccaccaca

SEQ ID NO: 1284 - RNA, 19 nt, Artificial Sequence
  siRNA antisense sequence
ugugguggaaggcuuggau

SEQ ID NO: 1285 - RNA, 19 nt, Artificial Sequence
  siRNA sense sequence
caagucauuuccucucuac

SEQ ID NO: 1286 - RNA, 19 nt, Artificial Sequence
  siRNA antisense sequence
guagagaggaaaugacuug

SEQ ID NO: 1287 - RNA, 19 nt, Artificial Sequence
  siRNA sense sequence
aagucauuuccucucuacg

SEQ ID NO: 1288 - RNA, 19 nt, Artificial Sequence
  siRNA antisense sequence
cguagagaggaaaugacuu

SEQ ID NO: 1289 - RNA, 19 nt, Artificial Sequence
  siRNA sense sequence
agucauuuccucucuacgg

SEQ ID NO: 1290 - RNA, 19 nt, Artificial Sequence
  siRNA antisense sequence
ccguagagaggaaaugacu

SEQ ID NO: 1291 - RNA, 19 nt, Artificial Sequence
  siRNA sense sequence
gucauuuccucucuacgga

SEQ ID NO: 1292 - RNA, 19 nt, Artificial Sequence
  siRNA antisense sequence
uccguagagaggaaaugac

SEQ ID NO: 1293 - RNA, 19 nt, Artificial Sequence
  siRNA sense sequence
ucauuuccucucuacggag

SEQ ID NO: 1294 - RNA, 19 nt, Artificial Sequence
  siRNA antisense sequence
cuccguagagaggaaauga

SEQ ID NO: 1295 - RNA, 19 nt, Artificial Sequence
  siRNA sense sequence
cauuuccucucuacggagu

SEQ ID NO: 1296 - RNA, 19 nt, Artificial Sequence
  siRNA antisense sequence
acuccguagagaggaaaug

SEQ ID NO: 1297 - RNA, 19 nt, Artificial Sequence
  siRNA sense sequence
auuuccucucuacggagua

SEQ ID NO: 1298 - RNA, 19 nt, Artificial Sequence
  siRNA antisense sequence
uacuccguagagaggaaau

SEQ ID NO: 1299 - RNA, 19 nt, Artificial Sequence
  siRNA sense sequence
uuuccucucuacggaguau

SEQ ID NO: 1300 - RNA, 19 nt, Artificial Sequence
  siRNA antisense sequence
auacuccguagagaggaaa

SEQ ID NO: 1301 - RNA, 19 nt, Artificial Sequence
  siRNA sense sequence
cucucuacggaguauuagu

SEQ ID NO: 1302 - RNA, 19 nt, Artificial Sequence
  siRNA antisense sequence
acuaauacuccguagagag

SEQ ID NO: 1303 - RNA, 19 nt, Artificial Sequence
  siRNA sense sequence
ucucuacggaguauuagua

SEQ ID NO: 1304 - RNA, 19 nt, Artificial Sequence
  siRNA antisense sequence
uacuaauacuccguagaga

SEQ ID NO: 1305 - RNA, 19 nt, Artificial Sequence
  siRNA sense sequence
uacggaguauuaguagcuu

SEQ ID NO: 1306 - RNA, 19 nt, Artificial Sequence
  siRNA antisense sequence
aagcuacuaauacuccgua

SEQ ID NO: 1307 - RNA, 19 nt, Artificial Sequence
  siRNA sense sequence
acggaguauuaguagcuua

SEQ ID NO: 1308 - RNA, 19 nt, Artificial Sequence
  siRNA antisense sequence
uaagcuacuaauacuccgu

SEQ ID NO: 1309 - RNA, 19 nt, Artificial Sequence
  siRNA sense sequence
cggaguauuaguagcuuaa

SEQ ID NO: 1310 - RNA, 19 nt, Artificial Sequence
  siRNA antisense sequence
uuaagcuacuaauacuccg

SEQ ID NO: 1311 - RNA, 19 nt, Artificial Sequence
  siRNA sense sequence
uuaguagcuuaaugggugc

SEQ ID NO: 1312 - RNA, 19 nt, Artificial Sequence
  siRNA antisense sequence
gcacccauuaagcuacuaa

SEQ ID NO: 1313 - RNA, 19 nt, Artificial Sequence
  siRNA sense sequence
uagcuuaaugggugcuuuc

SEQ ID NO: 1314 - RNA, 19 nt, Artificial Sequence
  siRNA antisense sequence
gaaagcacccauuaagcua

SEQ ID NO: 1315 - RNA, 19 nt, Artificial Sequence
  siRNA sense sequence
agcuuaaugggugcuuucu

SEQ ID NO: 1316 - RNA, 19 nt, Artificial Sequence
  siRNA antisense sequence
agaaagcacccauuaagcu

SEQ ID NO: 1317 - RNA, 19 nt, Artificial Sequence
  siRNA sense sequence
uaaugggugcuuucucagg

SEQ ID NO: 1318 - RNA, 19 nt, Artificial Sequence
  siRNA antisense sequence
ccugagaaagcacccauua

SEQ ID NO: 1319 - RNA, 19 nt, Artificial Sequence
  siRNA sense sequence
aaugggugcuuucucaggu

SEQ ID NO: 1320 - RNA, 19 nt, Artificial Sequence
  siRNA antisense sequence
accugagaaagcacccauu

SEQ ID NO: 1321 - RNA, 19 nt, Artificial Sequence
  siRNA sense sequence
ggugcuuucucagguuccu

SEQ ID NO: 1322 - RNA, 19 nt, Artificial Sequence
  siRNA antisense sequence
aggaaccugagaaagcacc

SEQ ID NO: 1323 - RNA, 19 nt, Artificial Sequence
  siRNA sense sequence
ucucagguuccuguaggcc

SEQ ID NO: 1324 - RNA, 19 nt, Artificial Sequence
  siRNA antisense sequence
ggccuacaggaaccugaga

SEQ ID NO: 1325 - RNA, 19 nt, Artificial Sequence
  siRNA sense sequence
cucagguuccuguaggcca

SEQ ID NO: 1326 - RNA, 19 nt, Artificial Sequence
  siRNA antisense sequence
uggccuacaggaaccugag

SEQ ID NO: 1327 - RNA, 19 nt, Artificial Sequence
  siRNA sense sequence
uccuguaggccaaagauua

SEQ ID NO: 1328 - RNA, 19 nt, Artificial Sequence
  siRNA antisense sequence
uaaucuuuggccuacagga

SEQ ID NO: 1329 - RNA, 19 nt, Artificial Sequence
  siRNA sense sequence
ccuguaggccaaagauuaa

SEQ ID NO: 1330 - RNA, 19 nt, Artificial Sequence
  siRNA antisense sequence
uuaaucuuuggccuacagg

SEQ ID NO: 1331 - RNA, 19 nt, Artificial Sequence
  siRNA sense sequence
cuguaggccaaagauuaau

SEQ ID NO: 1332 - RNA, 19 nt, Artificial Sequence
  siRNA antisense sequence
auuaaucuuuggccuacag

SEQ ID NO: 1333 - RNA, 19 nt, Artificial Sequence
  siRNA sense sequence
uguaggccaaagauuaauc

SEQ ID NO: 1334 - RNA, 19 nt, Artificial Sequence
  siRNA antisense sequence
gauuaaucuuuggccuaca

SEQ ID NO: 1335 - RNA, 19 nt, Artificial Sequence
  siRNA sense sequence
guaggccaaagauuaaucc

SEQ ID NO: 1336 - RNA, 19 nt, Artificial Sequence
  siRNA antisense sequence
ggauuaaucuuuggccuac

SEQ ID NO: 1337 - RNA, 19 nt, Artificial Sequence
  siRNA sense sequence
uaggccaaagauuaauccu

SEQ ID NO: 1338 - RNA, 19 nt, Artificial Sequence
  siRNA antisense sequence
aggauuaaucuuuggccua

SEQ ID NO: 1339 - RNA, 19 nt, Artificial Sequence
  siRNA sense sequence
aggccaaagauuaauccuc

SEQ ID NO: 1340 - RNA, 19 nt, Artificial Sequence
  siRNA antisense sequence
gaggauuaaucuuuggccu

SEQ ID NO: 1341 - RNA, 19 nt, Artificial Sequence
  siRNA sense sequence
ggccaaagauuaauccucu

SEQ ID NO: 1342 - RNA, 19 nt, Artificial Sequence
  siRNA antisense sequence
agaggauuaaucuuuggcc

SEQ ID NO: 1343 - RNA, 19 nt, Artificial Sequence
  siRNA sense sequence
gccaaagauuaauccucuc

SEQ ID NO: 1344 - RNA, 19 nt, Artificial Sequence
  siRNA antisense sequence
gagaggauuaaucuuuggc

SEQ ID NO: 1345 - RNA, 19 nt, Artificial Sequence
  siRNA sense sequence
ccaaagauuaauccucuca

SEQ ID NO: 1346 - RNA, 19 nt, Artificial Sequence
  siRNA antisense sequence
ugagaggauuaaucuuugg

SEQ ID NO: 1347 - RNA, 19 nt, Artificial Sequence
  siRNA sense sequence
caaagauuaauccucucac

SEQ ID NO: 1348 - RNA, 19 nt, Artificial Sequence
  siRNA antisense sequence
gugagaggauuaaucuuug

SEQ ID NO: 1349 - RNA, 19 nt, Artificial Sequence
  siRNA sense sequence
aaagauuaauccucucaca

SEQ ID NO: 1350 - RNA, 19 nt, Artificial Sequence
  siRNA antisense sequence
ugugagaggauuaaucuuu

SEQ ID NO: 1351 - RNA, 19 nt, Artificial Sequence
  siRNA sense sequence
uuaauccucucacaccauu

SEQ ID NO: 1352 - RNA, 19 nt, Artificial Sequence
  siRNA antisense sequence
aauggugugagaggauuaa

SEQ ID NO: 1353 - RNA, 19 nt, Artificial Sequence
  siRNA sense sequence
uaauccucucacaccauuu

SEQ ID NO: 1354 - RNA, 19 nt, Artificial Sequence
  siRNA antisense sequence
aaauggugugagaggauua

SEQ ID NO: 1355 - RNA, 19 nt, Artificial Sequence
  siRNA sense sequence
aauccucucacaccauuuc

SEQ ID NO: 1356 - RNA, 19 nt, Artificial Sequence
  siRNA antisense sequence
gaaauggugugagaggauu

SEQ ID NO: 1357 - RNA, 19 nt, Artificial Sequence
  siRNA sense sequence
caccauuuccuggauuuua

SEQ ID NO: 1358 - RNA, 19 nt, Artificial Sequence
  siRNA antisense sequence
uaaaauccaggaaauggug

SEQ ID NO: 1359 - RNA, 19 nt, Artificial Sequence
  siRNA sense sequence
accauuuccuggauuuuac

SEQ ID NO: 1360 - RNA, 19 nt, Artificial Sequence
  siRNA antisense sequence
guaaaauccaggaaauggu

SEQ ID NO: 1361 - RNA, 19 nt, Artificial Sequence
  siRNA sense sequence
ccauuuccuggauuuuacc

SEQ ID NO: 1362 - RNA, 19 nt, Artificial Sequence
  siRNA antisense sequence
gguaaaauccaggaaaugg

SEQ ID NO: 1363 - RNA, 19 nt, Artificial Sequence
  siRNA sense sequence
cauuuccuggauuuuaccc

SEQ ID NO: 1364 - RNA, 19 nt, Artificial Sequence
  siRNA antisense sequence
ggguaaaauccaggaaaug

SEQ ID NO: 1365 - RNA, 19 nt, Artificial Sequence
  siRNA sense sequence
aaauagaggacccagcuga

SEQ ID NO: 1366 - RNA, 19 nt, Artificial Sequence
  siRNA antisense sequence
ucagcuggguccucuauuu

SEQ ID NO: 1367 - RNA, 19 nt, Artificial Sequence
  siRNA sense sequence
aauagaggacccagcugag

SEQ ID NO: 1368 - RNA, 19 nt, Artificial Sequence
  siRNA antisense sequence
cucagcuggguccucuauu

SEQ ID NO: 1369 - RNA, 19 nt, Artificial Sequence
  siRNA sense sequence
cuaaauaggaauaguuugc

SEQ ID NO: 1370 - RNA, 19 nt, Artificial Sequence
  siRNA antisense sequence
gcaaacuauuccuauuuag

SEQ ID NO: 1371 - RNA, 19 nt, Artificial Sequence
  siRNA sense sequence
uaaauaggaauaguuugcc

SEQ ID NO: 1372 - RNA, 19 nt, Artificial Sequence
  siRNA antisense sequence
ggcaaacuauuccuauuua

SEQ ID NO: 1373 - RNA, 19 nt, Artificial Sequence
  siRNA sense sequence
aaauaggaauaguuugcca

SEQ ID NO: 1374 - RNA, 19 nt, Artificial Sequence
  siRNA antisense sequence
uggcaaacuauuccuauuu

SEQ ID NO: 1375 - RNA, 19 nt, Artificial Sequence
  siRNA sense sequence
uuugccaacuccacagcug

SEQ ID NO: 1376 - RNA, 19 nt, Artificial Sequence
  siRNA antisense sequence
cagcuguggaguuggcaaa

SEQ ID NO: 1377 - RNA, 19 nt, Artificial Sequence
  siRNA sense sequence
uugccaacuccacagcuga

SEQ ID NO: 1378 - RNA, 19 nt, Artificial Sequence
  siRNA antisense sequence
ucagcuguggaguuggcaa

SEQ ID NO: 1379 - RNA, 19 nt, Artificial Sequence
  siRNA sense sequence
ugccaacuccacagcugag

SEQ ID NO: 1380 - RNA, 19 nt, Artificial Sequence
  siRNA antisense sequence
cucagcuguggaguuggca

SEQ ID NO: 1381 - RNA, 19 nt, Artificial Sequence
  siRNA sense sequence
gccaacuccacagcugagg

SEQ ID NO: 1382 - RNA, 19 nt, Artificial Sequence
  siRNA antisense sequence
ccucagcuguggaguuggc

SEQ ID NO: 1383 - RNA, 19 nt, Artificial Sequence
  siRNA sense sequence
ccaacuccacagcugagga

SEQ ID NO: 1384 - RNA, 19 nt, Artificial Sequence
  siRNA antisense sequence
uccucagcuguggaguugg

SEQ ID NO: 1385 - RNA, 19 nt, Artificial Sequence
  siRNA sense sequence
agucuucaaggugggaucg

SEQ ID NO: 1386 - RNA, 19 nt, Artificial Sequence
  siRNA antisense sequence
cgaucccaccuugaagacu

SEQ ID NO: 1387 - RNA, 19 nt, Artificial Sequence
  siRNA sense sequence
gucuucaaggugggaucgu

SEQ ID NO: 1388 - RNA, 19 nt, Artificial Sequence
  siRNA antisense sequence
acgaucccaccuugaagac

SEQ ID NO: 1389 - RNA, 19 nt, Artificial Sequence
  siRNA sense sequence
ucuucaaggugggaucgua

SEQ ID NO: 1390 - RNA, 19 nt, Artificial Sequence
  siRNA antisense sequence
uacgaucccaccuugaaga

SEQ ID NO: 1391 - RNA, 19 nt, Artificial Sequence
  siRNA sense sequence
cuucaaggugggaucguaa

SEQ ID NO: 1392 - RNA, 19 nt, Artificial Sequence
  siRNA antisense sequence
uuacgaucccaccuugaag

SEQ ID NO: 1393 - RNA, 19 nt, Artificial Sequence
  siRNA sense sequence
uucaaggugggaucguaau

SEQ ID NO: 1394 - RNA, 19 nt, Artificial Sequence
  siRNA antisense sequence
auuacgaucccaccuugaa

SEQ ID NO: 1395 - RNA, 19 nt, Artificial Sequence
  siRNA sense sequence
ucaaggugggaucguaaua

SEQ ID NO: 1396 - RNA, 19 nt, Artificial Sequence
  siRNA antisense sequence
uauuacgaucccaccuuga

SEQ ID NO: 1397 - RNA, 19 nt, Artificial Sequence
  siRNA sense sequence
caaggugggaucguaauaa

SEQ ID NO: 1398 - RNA, 19 nt, Artificial Sequence
  siRNA antisense sequence
uuauuacgaucccaccuug

SEQ ID NO: 1399 - RNA, 19 nt, Artificial Sequence
  siRNA sense sequence
gugggaucguaauaauggc

SEQ ID NO: 1400 - RNA, 19 nt, Artificial Sequence
  siRNA antisense sequence
gccauuauuacgaucccac

SEQ ID NO: 1401 - RNA, 19 nt, Artificial Sequence
  siRNA sense sequence
ugggaucguaauaauggca

SEQ ID NO: 1402 - RNA, 19 nt, Artificial Sequence
  siRNA antisense sequence
ugccauuauuacgauccca

SEQ ID NO: 1403 - RNA, 19 nt, Artificial Sequence
  siRNA sense sequence
gggaucguaauaauggcaa

SEQ ID NO: 1404 - RNA, 19 nt, Artificial Sequence
  siRNA antisense sequence
uugccauuauuacgauccc

SEQ ID NO: 1405 - RNA, 19 nt, Artificial Sequence
  siRNA sense sequence
ggaucguaauaauggcaaa

SEQ ID NO: 1406 - RNA, 19 nt, Artificial Sequence
  siRNA antisense sequence
uuugccauuauuacgaucc

SEQ ID NO: 1407 - RNA, 19 nt, Artificial Sequence
  siRNA sense sequence
gaucguaauaauggcaaaa

SEQ ID NO: 1408 - RNA, 19 nt, Artificial Sequence
  siRNA antisense sequence
uuuugccauuauuacgauc

SEQ ID NO: 1409 - RNA, 19 nt, Artificial Sequence
  siRNA sense sequence
aucguaauaauggcaaaag

SEQ ID NO: 1410 - RNA, 19 nt, Artificial Sequence
  siRNA antisense sequence
cuuuugccauuauuacgau

SEQ ID NO: 1411 - RNA, 19 nt, Artificial Sequence
  siRNA sense sequence
agaauuuggcauuucaagu

SEQ ID NO: 1412 - RNA, 19 nt, Artificial Sequence
  siRNA antisense sequence
acuugaaaugccaaauucu

SEQ ID NO: 1413 - RNA, 19 nt, Artificial Sequence
  siRNA sense sequence
gaauuuggcauuucaaguc

SEQ ID NO: 1414 - RNA, 19 nt, Artificial Sequence
  siRNA antisense sequence
gacuugaaaugccaaauuc

SEQ ID NO: 1415 - RNA, 19 nt, Artificial Sequence
  siRNA sense sequence
aauuuggcauuucaaguca

SEQ ID NO: 1416 - RNA, 19 nt, Artificial Sequence
  siRNA antisense sequence
ugacuugaaaugccaaauu

SEQ ID NO: 1417 - RNA, 19 nt, Artificial Sequence
  siRNA sense sequence
auuuggcauuucaagucaa

SEQ ID NO: 1418 - RNA, 19 nt, Artificial Sequence
  siRNA antisense sequence
uugacuugaaaugccaaau

SEQ ID NO: 1419 - RNA, 19 nt, Artificial Sequence
  siRNA sense sequence
uuuggcauuucaagucaag

SEQ ID NO: 1420 - RNA, 19 nt, Artificial Sequence
  siRNA antisense sequence
cuugacuugaaaugccaaa

SEQ ID NO: 1421 - RNA, 19 nt, Artificial Sequence
  siRNA sense sequence
uuggcauuucaagucaagg

SEQ ID NO: 1422 - RNA, 19 nt, Artificial Sequence
  siRNA antisense sequence
ccuugacuugaaaugccaa

SEQ ID NO: 1423 - RNA, 19 nt, Artificial Sequence
  siRNA sense sequence
uggcauuucaagucaagga

SEQ ID NO: 1424 - RNA, 19 nt, Artificial Sequence
  siRNA antisense sequence
uccuugacuugaaaugcca

SEQ ID NO: 1425 - RNA, 19 nt, Artificial Sequence
  siRNA sense sequence
uucaagucaaggaugcuau

SEQ ID NO: 1426 - RNA, 19 nt, Artificial Sequence
  siRNA antisense sequence
auagcauccuugacuugaa

SEQ ID NO: 1427 - RNA, 19 nt, Artificial Sequence
  siRNA sense sequence
ucaagucaaggaugcuauc

SEQ ID NO: 1428 - RNA, 19 nt, Artificial Sequence
  siRNA antisense sequence
gauagcauccuugacuuga

SEQ ID NO: 1429 - RNA, 19 nt, Artificial Sequence
  siRNA sense sequence
caagucaaggaugcuaucu

SEQ ID NO: 1430 - RNA, 19 nt, Artificial Sequence
  siRNA antisense sequence
agauagcauccuugacuug

SEQ ID NO: 1431 - RNA, 19 nt, Artificial Sequence
  siRNA sense sequence
aagucaaggaugcuaucua

SEQ ID NO: 1432 - RNA, 19 nt, Artificial Sequence
  siRNA antisense sequence
uagauagcauccuugacuu

SEQ ID NO: 1433 - RNA, 19 nt, Artificial Sequence
  siRNA sense sequence
agucaaggaugcuaucuaa

SEQ ID NO: 1434 - RNA, 19 nt, Artificial Sequence
  siRNA antisense sequence
uuagauagcauccuugacu

SEQ ID NO: 1435 - RNA, 19 nt, Artificial Sequence
  siRNA sense sequence
gucaaggaugcuaucuaaa

SEQ ID NO: 1436 - RNA, 19 nt, Artificial Sequence
  siRNA antisense sequence
uuuagauagcauccuugac

SEQ ID NO: 1437 - RNA, 19 nt, Artificial Sequence
  siRNA sense sequence
ucaaggaugcuaucuaaau

SEQ ID NO: 1438 - RNA, 19 nt, Artificial Sequence
  siRNA antisense sequence
auuuagauagcauccuuga

SEQ ID NO: 1439 - RNA, 19 nt, Artificial Sequence
  siRNA sense sequence
caaggaugcuaucuaaaug

SEQ ID NO: 1440 - RNA, 19 nt, Artificial Sequence
  siRNA antisense sequence
cauuuagauagcauccuug

SEQ ID NO: 1441 - RNA, 19 nt, Artificial Sequence
  siRNA sense sequence
aaggaugcuaucuaaaugg

SEQ ID NO: 1442 - RNA, 19 nt, Artificial Sequence
  siRNA antisense sequence
ccauuuagauagcauccuu

SEQ ID NO: 1443 - RNA, 19 nt, Artificial Sequence
  siRNA sense sequence
aggaugcuaucuaaauggg

SEQ ID NO: 1444 - RNA, 19 nt, Artificial Sequence
  siRNA antisense sequence
cccauuuagauagcauccu

SEQ ID NO: 1445 - RNA, 19 nt, Artificial Sequence
  siRNA sense sequence
ggaugcuaucuaaaugggc

SEQ ID NO: 1446 - RNA, 19 nt, Artificial Sequence
  siRNA antisense sequence
gcccauuuagauagcaucc

SEQ ID NO: 1447 - RNA, 19 nt, Artificial Sequence
  siRNA sense sequence
gaugcuaucuaaaugggcc

SEQ ID NO: 1448 - RNA, 19 nt, Artificial Sequence
  siRNA antisense sequence
ggcccauuuagauagcauc

SEQ ID NO: 1449 - RNA, 19 nt, Artificial Sequence
  siRNA sense sequence
augcuaucuaaaugggccu

SEQ ID NO: 1450 - RNA, 19 nt, Artificial Sequence
  siRNA antisense sequence
aggcccauuuagauagcau

SEQ ID NO: 1451 - RNA, 19 nt, Artificial Sequence
  siRNA sense sequence
ugcuaucuaaaugggccuu

SEQ ID NO: 1452 - RNA, 19 nt, Artificial Sequence
  siRNA antisense sequence
aaggcccauuuagauagca

SEQ ID NO: 1453 - RNA, 19 nt, Artificial Sequence
  siRNA sense sequence
gcuaucuaaaugggccuuu

SEQ ID NO: 1454 - RNA, 19 nt, Artificial Sequence
  siRNA antisense sequence
aaaggcccauuuagauagc

SEQ ID NO: 1455 - RNA, 19 nt, Artificial Sequence
  siRNA sense sequence
cuaucuaaaugggccuuuu

SEQ ID NO: 1456 - RNA, 19 nt, Artificial Sequence
  siRNA antisense sequence
aaaaggcccauuuagauag

SEQ ID NO: 1457 - RNA, 19 nt, Artificial Sequence
  siRNA sense sequence
aaaugggccuuuuaauuca

SEQ ID NO: 1458 - RNA, 19 nt, Artificial Sequence
  siRNA antisense sequence
ugaauuaaaaggcccauuu

SEQ ID NO: 1459 - RNA, 19 nt, Artificial Sequence
  siRNA sense sequence
aaugggccuuuuaauucaa

SEQ ID NO: 1460 - RNA, 19 nt, Artificial Sequence
  siRNA antisense sequence
uugaauuaaaaggcccauu

SEQ ID NO: 1461 - RNA, 19 nt, Artificial Sequence
  siRNA sense sequence
augggccuuuuaauucaaa

SEQ ID NO: 1462 - RNA, 19 nt, Artificial Sequence
  siRNA antisense sequence
uuugaauuaaaaggcccau

SEQ ID NO: 1463 - RNA, 19 nt, Artificial Sequence
  siRNA sense sequence
ugggccuuuuaauucaaau

SEQ ID NO: 1464 - RNA, 19 nt, Artificial Sequence
  siRNA antisense sequence
auuugaauuaaaaggccca

SEQ ID NO: 1465 - RNA, 19 nt, Artificial Sequence
  siRNA sense sequence
gggccuuuuaauucaaauc

SEQ ID NO: 1466 - RNA, 19 nt, Artificial Sequence
  siRNA antisense sequence
gauuugaauuaaaaggccc

SEQ ID NO: 1467 - RNA, 19 nt, Artificial Sequence
  siRNA sense sequence
ggccuuuuaauucaaaucu

SEQ ID NO: 1468 - RNA, 19 nt, Artificial Sequence
  siRNA antisense sequence
agauuugaauuaaaaggcc

SEQ ID NO: 1469 - RNA, 19 nt, Artificial Sequence
  siRNA sense sequence
uucaaaucuacugacuauc

SEQ ID NO: 1470 - RNA, 19 nt, Artificial Sequence
  siRNA antisense sequence
gauagucaguagauuugaa

SEQ ID NO: 1471 - RNA, 19 nt, Artificial Sequence
  siRNA sense sequence
ucaaaucuacugacuaucc

SEQ ID NO: 1472 - RNA, 19 nt, Artificial Sequence
  siRNA antisense sequence
ggauagucaguagauuuga

SEQ ID NO: 1473 - RNA, 19 nt, Artificial Sequence
  siRNA sense sequence
caaaucuacugacuauccc

SEQ ID NO: 1474 - RNA, 19 nt, Artificial Sequence
  siRNA antisense sequence
gggauagucaguagauuug

SEQ ID NO: 1475 - RNA, 19 nt, Artificial Sequence
  siRNA sense sequence
aaaucuacugacuaucccg

SEQ ID NO: 1476 - RNA, 19 nt, Artificial Sequence
  siRNA antisense sequence
cgggauagucaguagauuu

SEQ ID NO: 1477 - RNA, 19 nt, Artificial Sequence
  siRNA sense sequence
cuacugacuaucccgaagc

SEQ ID NO: 1478 - RNA, 19 nt, Artificial Sequence
  siRNA antisense sequence
gcuucgggauagucaguag

SEQ ID NO: 1479 - RNA, 19 nt, Artificial Sequence
  siRNA sense sequence
uacugacuaucccgaagca

SEQ ID NO: 1480 - RNA, 19 nt, Artificial Sequence
  siRNA antisense sequence
ugcuucgggauagucagua

SEQ ID NO: 1481 - RNA, 19 nt, Artificial Sequence
  siRNA sense sequence
acugacuaucccgaagcaa

SEQ ID NO: 1482 - RNA, 19 nt, Artificial Sequence
  siRNA antisense sequence
uugcuucgggauagucagu

SEQ ID NO: 1483 - RNA, 19 nt, Artificial Sequence
  siRNA sense sequence
cugacuaucccgaagcaaa

SEQ ID NO: 1484 - RNA, 19 nt, Artificial Sequence
  siRNA antisense sequence
uuugcuucgggauagucag

SEQ ID NO: 1485 - RNA, 19 nt, Artificial Sequence
  siRNA sense sequence
ugacuaucccgaagcaaag

SEQ ID NO: 1486 - RNA, 19 nt, Artificial Sequence
  siRNA antisense sequence
cuuugcuucgggauaguca

SEQ ID NO: 1487 - RNA, 19 nt, Artificial Sequence
  siRNA sense sequence
gacuaucccgaagcaaagg

SEQ ID NO: 1488 - RNA, 19 nt, Artificial Sequence
  siRNA antisense sequence
ccuuugcuucgggauaguc

SEQ ID NO: 1489 - RNA, 19 nt, Artificial Sequence
  siRNA sense sequence
acuaucccgaagcaaaggu

SEQ ID NO: 1490 - RNA, 19 nt, Artificial Sequence
  siRNA antisense sequence
accuuugcuucgggauagu

SEQ ID NO: 1491 - RNA, 19 nt, Artificial Sequence
  siRNA sense sequence
cuaucccgaagcaaagguc

SEQ ID NO: 1492 - RNA, 19 nt, Artificial Sequence
  siRNA antisense sequence
gaccuuugcuucgggauag

SEQ ID NO: 1493 - RNA, 19 nt, Artificial Sequence
  siRNA sense sequence
cccgaagcaaaggucaucu

SEQ ID NO: 1494 - RNA, 19 nt, Artificial Sequence
  siRNA antisense sequence
agaugaccuuugcuucggg

SEQ ID NO: 1495 - RNA, 19 nt, Artificial Sequence
  siRNA sense sequence
ccgaagcaaaggucaucuu

SEQ ID NO: 1496 - RNA, 19 nt, Artificial Sequence
  siRNA antisense sequence
aagaugaccuuugcuucgg

SEQ ID NO: 1497 - RNA, 19 nt, Artificial Sequence
  siRNA sense sequence
aagcaaaggucaucuucug

SEQ ID NO: 1498 - RNA, 19 nt, Artificial Sequence
  siRNA antisense sequence
cagaagaugaccuuugcuu

SEQ ID NO: 1499 - RNA, 19 nt, Artificial Sequence
  siRNA sense sequence
agcaaaggucaucuucugu

SEQ ID NO: 1500 - RNA, 19 nt, Artificial Sequence
  siRNA antisense sequence
acagaagaugaccuuugcu

SEQ ID NO: 1501 - RNA, 19 nt, Artificial Sequence
  siRNA sense sequence
gcaaaggucaucuucugua

SEQ ID NO: 1502 - RNA, 19 nt, Artificial Sequence
  siRNA antisense sequence
uacagaagaugaccuuugc

SEQ ID NO: 1503 - RNA, 19 nt, Artificial Sequence
  siRNA sense sequence
caaaggucaucuucuguau

SEQ ID NO: 1504 - RNA, 19 nt, Artificial Sequence
  siRNA antisense sequence
auacagaagaugaccuuug

SEQ ID NO: 1505 - RNA, 19 nt, Artificial Sequence
  siRNA sense sequence
aaaggucaucuucuguauc

SEQ ID NO: 1506 - RNA, 19 nt, Artificial Sequence
  siRNA antisense sequence
gauacagaagaugaccuuu

SEQ ID NO: 1507 - RNA, 19 nt, Artificial Sequence
  siRNA sense sequence
aaggucaucuucuguauca

SEQ ID NO: 1508 - RNA, 19 nt, Artificial Sequence
  siRNA antisense sequence
ugauacagaagaugaccuu

SEQ ID NO: 1509 - RNA, 19 nt, Artificial Sequence
  siRNA sense sequence
aggucaucuucuguaucac

SEQ ID NO: 1510 - RNA, 19 nt, Artificial Sequence
  siRNA antisense sequence
gugauacagaagaugaccu

SEQ ID NO: 1511 - RNA, 19 nt, Artificial Sequence
  siRNA sense sequence
ucaucuucuguaucacuga

SEQ ID NO: 1512 - RNA, 19 nt, Artificial Sequence
  siRNA antisense sequence
ucagugauacagaagauga

SEQ ID NO: 1513 - RNA, 19 nt, Artificial Sequence
  siRNA sense sequence
cuucuguaucacugacuca

SEQ ID NO: 1514 - RNA, 19 nt, Artificial Sequence
  siRNA antisense sequence
ugagucagugauacagaag

SEQ ID NO: 1515 - RNA, 19 nt, Artificial Sequence
  siRNA sense sequence
uucuguaucacugacucac

SEQ ID NO: 1516 - RNA, 19 nt, Artificial Sequence
  siRNA antisense sequence
gugagucagugauacagaa

SEQ ID NO: 1517 - RNA, 19 nt, Artificial Sequence
  siRNA sense sequence
ucuguaucacugacucacc

SEQ ID NO: 1518 - RNA, 19 nt, Artificial Sequence
  siRNA antisense sequence
ggugagucagugauacaga

SEQ ID NO: 1519 - RNA, 19 nt, Artificial Sequence
  siRNA sense sequence
cuguaucacugacucacca

SEQ ID NO: 1520 - RNA, 19 nt, Artificial Sequence
  siRNA antisense sequence
uggugagucagugauacag

SEQ ID NO: 1521 - RNA, 19 nt, Artificial Sequence
  siRNA sense sequence
uguaucacugacucaccau

SEQ ID NO: 1522 - RNA, 19 nt, Artificial Sequence
  siRNA antisense sequence
auggugagucagugauaca

SEQ ID NO: 1523 - RNA, 19 nt, Artificial Sequence
  siRNA sense sequence
guaucacugacucaccaug

SEQ ID NO: 1524 - RNA, 19 nt, Artificial Sequence
  siRNA antisense sequence
cauggugagucagugauac

SEQ ID NO: 1525 - RNA, 19 nt, Artificial Sequence
  siRNA sense sequence
uaucacugacucaccaugu

SEQ ID NO: 1526 - RNA, 19 nt, Artificial Sequence
  siRNA antisense sequence
acauggugagucagugaua

SEQ ID NO: 1527 - RNA, 19 nt, Artificial Sequence
  siRNA sense sequence
aucacugacucaccaugua

SEQ ID NO: 1528 - RNA, 19 nt, Artificial Sequence
  siRNA antisense sequence
uacauggugagucagugau

SEQ ID NO: 1529 - RNA, 19 nt, Artificial Sequence
  siRNA sense sequence
ucacugacucaccauguag

SEQ ID NO: 1530 - RNA, 19 nt, Artificial Sequence
  siRNA antisense sequence
cuacauggugagucaguga

SEQ ID NO: 1531 - RNA, 19 nt, Artificial Sequence
  siRNA sense sequence
cacugacucaccauguagg

SEQ ID NO: 1532 - RNA, 19 nt, Artificial Sequence
  siRNA antisense sequence
ccuacauggugagucagug

SEQ ID NO: 1533 - RNA, 19 nt, Artificial Sequence
  siRNA sense sequence
acugacucaccauguaggu

SEQ ID NO: 1534 - RNA, 19 nt, Artificial Sequence
  siRNA antisense sequence
accuacauggugagucagu

SEQ ID NO: 1535 - RNA, 19 nt, Artificial Sequence
  siRNA sense sequence
ugacucaccauguaggucu

SEQ ID NO: 1536 - RNA, 19 nt, Artificial Sequence
  siRNA antisense sequence
agaccuacauggugaguca

SEQ ID NO: 1537 - RNA, 19 nt, Artificial Sequence
  siRNA sense sequence
gacucaccauguaggucuc

SEQ ID NO: 1538 - RNA, 19 nt, Artificial Sequence
  siRNA antisense sequence
gagaccuacauggugaguc

SEQ ID NO: 1539 - RNA, 19 nt, Artificial Sequence
  siRNA sense sequence
acucaccauguaggucuca

SEQ ID NO: 1540 - RNA, 19 nt, Artificial Sequence
  siRNA antisense sequence
ugagaccuacauggugagu

SEQ ID NO: 1541 - RNA, 19 nt, Artificial Sequence
  siRNA sense sequence
cucaccauguaggucucag

SEQ ID NO: 1542 - RNA, 19 nt, Artificial Sequence
  siRNA antisense sequence
cugagaccuacauggugag

SEQ ID NO: 1543 - RNA, 19 nt, Artificial Sequence
  siRNA sense sequence
ucaccauguaggucucaga

SEQ ID NO: 1544 - RNA, 19 nt, Artificial Sequence
  siRNA antisense sequence
ucugagaccuacaugguga

SEQ ID NO: 1545 - RNA, 19 nt, Artificial Sequence
  siRNA sense sequence
caccauguaggucucagaa

SEQ ID NO: 1546 - RNA, 19 nt, Artificial Sequence
  siRNA antisense sequence
uucugagaccuacauggug

SEQ ID NO: 1547 - RNA, 19 nt, Artificial Sequence
  siRNA sense sequence
accauguaggucucagaag

SEQ ID NO: 1548 - RNA, 19 nt, Artificial Sequence
  siRNA antisense sequence
cuucugagaccuacauggu

SEQ ID NO: 1549 - RNA, 19 nt, Artificial Sequence
  siRNA sense sequence
ccauguaggucucagaaga

SEQ ID NO: 1550 - RNA, 19 nt, Artificial Sequence
  siRNA antisense sequence
ucuucugagaccuacaugg

SEQ ID NO: 1551 - RNA, 19 nt, Artificial Sequence
  siRNA sense sequence
cauguaggucucagaagag

SEQ ID NO: 1552 - RNA, 19 nt, Artificial Sequence
  siRNA antisense sequence
cucuucugagaccuacaug

SEQ ID NO: 1553 - RNA, 19 nt, Artificial Sequence
  siRNA sense sequence
auguaggucucagaagagc

SEQ ID NO: 1554 - RNA, 19 nt, Artificial Sequence
  siRNA antisense sequence
gcucuucugagaccuacau

SEQ ID NO: 1555 - RNA, 19 nt, Artificial Sequence
  siRNA sense sequence
uguaggucucagaagagcu

SEQ ID NO: 1556 - RNA, 19 nt, Artificial Sequence
  siRNA antisense sequence
agcucuucugagaccuaca

SEQ ID NO: 1557 - RNA, 19 nt, Artificial Sequence
  siRNA sense sequence
guaggucucagaagagcug

SEQ ID NO: 1558 - RNA, 19 nt, Artificial Sequence
  siRNA antisense sequence
cagcucuucugagaccuac

SEQ ID NO: 1559 - RNA, 19 nt, Artificial Sequence
  siRNA sense sequence
gucucagaagagcuggugu

SEQ ID NO: 1560 - RNA, 19 nt, Artificial Sequence
  siRNA antisense sequence
acaccagcucuucugagac

SEQ ID NO: 1561 - RNA, 19 nt, Artificial Sequence
  siRNA sense sequence
ucucagaagagcugguguu

SEQ ID NO: 1562 - RNA, 19 nt, Artificial Sequence
  siRNA antisense sequence
aacaccagcucuucugaga

SEQ ID NO: 1563 - RNA, 19 nt, Artificial Sequence
  siRNA sense sequence
cucagaagagcugguguuu

SEQ ID NO: 1564 - RNA, 19 nt, Artificial Sequence
  siRNA antisense sequence
aaacaccagcucuucugag

SEQ ID NO: 1565 - RNA, 19 nt, Artificial Sequence
  siRNA sense sequence
ucagaagagcugguguuuu

SEQ ID NO: 1566 - RNA, 19 nt, Artificial Sequence
  siRNA antisense sequence
aaaacaccagcucuucuga

SEQ ID NO: 1567 - RNA, 19 nt, Artificial Sequence
  siRNA sense sequence
cagaagagcugguguuuug

SEQ ID NO: 1568 - RNA, 19 nt, Artificial Sequence
  siRNA antisense sequence
caaaacaccagcucuucug

SEQ ID NO: 1569 - RNA, 19 nt, Artificial Sequence
  siRNA sense sequence
agaagagcugguguuuugu

SEQ ID NO: 1570 - RNA, 19 nt, Artificial Sequence
  siRNA antisense sequence
acaaaacaccagcucuucu

SEQ ID NO: 1571 - RNA, 19 nt, Artificial Sequence
  siRNA sense sequence
gaagagcugguguuuuguc

SEQ ID NO: 1572 - RNA, 19 nt, Artificial Sequence
  siRNA antisense sequence
gacaaaacaccagcucuuc

SEQ ID NO: 1573 - RNA, 19 nt, Artificial Sequence
  siRNA sense sequence
aagagcugguguuuugucc

SEQ ID NO: 1574 - RNA, 19 nt, Artificial Sequence
  siRNA antisense sequence
ggacaaaacaccagcucuu

SEQ ID NO: 1575 - RNA, 19 nt, Artificial Sequence
  siRNA sense sequence
agagcugguguuuugucca

SEQ ID NO: 1576 - RNA, 19 nt, Artificial Sequence
  siRNA antisense sequence
uggacaaaacaccagcucu

SEQ ID NO: 1577 - RNA, 19 nt, Artificial Sequence
  siRNA sense sequence
guguuuuguccagucugag

SEQ ID NO: 1578 - RNA, 19 nt, Artificial Sequence
  siRNA antisense sequence
cucagacuggacaaaacac

SEQ ID NO: 1579 - RNA, 19 nt, Artificial Sequence
  siRNA sense sequence
uuuguccagucugaguccu

SEQ ID NO: 1580 - RNA, 19 nt, Artificial Sequence
  siRNA antisense sequence
aggacucagacuggacaaa

SEQ ID NO: 1581 - RNA, 19 nt, Artificial Sequence
  siRNA sense sequence
uguccagucugaguccugu

SEQ ID NO: 1582 - RNA, 19 nt, Artificial Sequence
  siRNA antisense sequence
acaggacucagacuggaca

SEQ ID NO: 1583 - RNA, 19 nt, Artificial Sequence
  siRNA sense sequence
guccagucugaguccugug

SEQ ID NO: 1584 - RNA, 19 nt, Artificial Sequence
  siRNA antisense sequence
cacaggacucagacuggac

SEQ ID NO: 1585 - RNA, 19 nt, Artificial Sequence
  siRNA sense sequence
agucugaguccugugaauu

SEQ ID NO: 1586 - RNA, 19 nt, Artificial Sequence
  siRNA antisense sequence
aauucacaggacucagacu

SEQ ID NO: 1587 - RNA, 19 nt, Artificial Sequence
  siRNA sense sequence
uccugugaauucuuccaac

SEQ ID NO: 1588 - RNA, 19 nt, Artificial Sequence
  siRNA antisense sequence
guuggaagaauucacagga

SEQ ID NO: 1589 - RNA, 19 nt, Artificial Sequence
  siRNA sense sequence
ccaaccauggaccaguguc

SEQ ID NO: 1590 - RNA, 19 nt, Artificial Sequence
  siRNA antisense sequence
gacacugguccaugguugg

SEQ ID NO: 1591 - RNA, 19 nt, Artificial Sequence
  siRNA sense sequence
caaccauggaccagugucu

SEQ ID NO: 1592 - RNA, 19 nt, Artificial Sequence
  siRNA antisense sequence
agacacugguccaugguug

SEQ ID NO: 1593 - RNA, 19 nt, Artificial Sequence
  siRNA sense sequence
aaccauggaccagugucua

SEQ ID NO: 1594 - RNA, 19 nt, Artificial Sequence
  siRNA antisense sequence
uagacacugguccaugguu

SEQ ID NO: 1595 - RNA, 19 nt, Artificial Sequence
  siRNA sense sequence
accauggaccagugucuac

SEQ ID NO: 1596 - RNA, 19 nt, Artificial Sequence
  siRNA antisense sequence
guagacacugguccauggu

SEQ ID NO: 1597 - RNA, 19 nt, Artificial Sequence
  siRNA sense sequence
agugucuacuggcucucua

SEQ ID NO: 1598 - RNA, 19 nt, Artificial Sequence
  siRNA antisense sequence
uagagagccaguagacacu

SEQ ID NO: 1599 - RNA, 19 nt, Artificial Sequence
  siRNA sense sequence
gugucuacuggcucucuaa

SEQ ID NO: 1600 - RNA, 19 nt, Artificial Sequence
  siRNA antisense sequence
uuagagagccaguagacac

SEQ ID NO: 1601 - RNA, 19 nt, Artificial Sequence
  siRNA sense sequence
ugucuacuggcucucuaac

SEQ ID NO: 1602 - RNA, 19 nt, Artificial Sequence
  siRNA antisense sequence
guuagagagccaguagaca

SEQ ID NO: 1603 - RNA, 19 nt, Artificial Sequence
  siRNA sense sequence
gucuacuggcucucuaacu

SEQ ID NO: 1604 - RNA, 19 nt, Artificial Sequence
  siRNA antisense sequence
aguuagagagccaguagac

SEQ ID NO: 1605 - RNA, 19 nt, Artificial Sequence
  siRNA sense sequence
ucuacuggcucucuaacua

SEQ ID NO: 1606 - RNA, 19 nt, Artificial Sequence
  siRNA antisense sequence
uaguuagagagccaguaga

SEQ ID NO: 1607 - RNA, 19 nt, Artificial Sequence
  siRNA sense sequence
cuacuggcucucuaacuaa

SEQ ID NO: 1608 - RNA, 19 nt, Artificial Sequence
  siRNA antisense sequence
uuaguuagagagccaguag

SEQ ID NO: 1609 - RNA, 19 nt, Artificial Sequence
  siRNA sense sequence
uacuggcucucuaacuaau

SEQ ID NO: 1610 - RNA, 19 nt, Artificial Sequence
  siRNA antisense sequence
auuaguuagagagccagua

SEQ ID NO: 1611 - RNA, 19 nt, Artificial Sequence
  siRNA sense sequence
acuggcucucuaacuaauc

SEQ ID NO: 1612 - RNA, 19 nt, Artificial Sequence
  siRNA antisense sequence
gauuaguuagagagccagu

SEQ ID NO: 1613 - RNA, 19 nt, Artificial Sequence
  siRNA sense sequence
cuggcucucuaacuaaucg

SEQ ID NO: 1614 - RNA, 19 nt, Artificial Sequence
  siRNA antisense sequence
cgauuaguuagagagccag

SEQ ID NO: 1615 - RNA, 19 nt, Artificial Sequence
  siRNA sense sequence
uggcucucuaacuaaucga

SEQ ID NO: 1616 - RNA, 19 nt, Artificial Sequence
  siRNA antisense sequence
ucgauuaguuagagagcca

SEQ ID NO: 1617 - RNA, 19 nt, Artificial Sequence
  siRNA sense sequence
ggcucucuaacuaaucgau

SEQ ID NO: 1618 - RNA, 19 nt, Artificial Sequence
  siRNA antisense sequence
aucgauuaguuagagagcc

SEQ ID NO: 1619 - RNA, 19 nt, Artificial Sequence
  siRNA sense sequence
cucuaacuaaucgaucacc

SEQ ID NO: 1620 - RNA, 19 nt, Artificial Sequence
  siRNA antisense sequence
ggugaucgauuaguuagag

SEQ ID NO: 1621 - RNA, 19 nt, Artificial Sequence
  siRNA sense sequence
ucuaacuaaucgaucaccc

SEQ ID NO: 1622 - RNA, 19 nt, Artificial Sequence
  siRNA antisense sequence
gggugaucgauuaguuaga

SEQ ID NO: 1623 - RNA, 19 nt, Artificial Sequence
  siRNA sense sequence
cuaacuaaucgaucaccca

SEQ ID NO: 1624 - RNA, 19 nt, Artificial Sequence
  siRNA antisense sequence
ugggugaucgauuaguuag

SEQ ID NO: 1625 - RNA, 19 nt, Artificial Sequence
  siRNA sense sequence
uaacuaaucgaucacccau

SEQ ID NO: 1626 - RNA, 19 nt, Artificial Sequence
  siRNA antisense sequence
augggugaucgauuaguua

SEQ ID NO: 1627 - RNA, 19 nt, Artificial Sequence
  siRNA sense sequence
aacuaaucgaucacccaua

SEQ ID NO: 1628 - RNA, 19 nt, Artificial Sequence
  siRNA antisense sequence
uaugggugaucgauuaguu

SEQ ID NO: 1629 - RNA, 19 nt, Artificial Sequence
  siRNA sense sequence
acuaaucgaucacccauag

SEQ ID NO: 1630 - RNA, 19 nt, Artificial Sequence
  siRNA antisense sequence
cuaugggugaucgauuagu

SEQ ID NO: 1631 - RNA, 19 nt, Artificial Sequence
  siRNA sense sequence
cuaaucgaucacccauaga

SEQ ID NO: 1632 - RNA, 19 nt, Artificial Sequence
  siRNA antisense sequence
ucuaugggugaucgauuag

SEQ ID NO: 1633 - RNA, 19 nt, Artificial Sequence
  siRNA sense sequence
uaaucgaucacccauagaa

SEQ ID NO: 1634 - RNA, 19 nt, Artificial Sequence
  siRNA antisense sequence
uucuaugggugaucgauua

SEQ ID NO: 1635 - RNA, 19 nt, Artificial Sequence
  siRNA sense sequence
aaucgaucacccauagaau

SEQ ID NO: 1636 - RNA, 19 nt, Artificial Sequence
  siRNA antisense sequence
auucuaugggugaucgauu

SEQ ID NO: 1637 - RNA, 19 nt, Artificial Sequence
  siRNA sense sequence
aucgaucacccauagaauu

SEQ ID NO: 1638 - RNA, 19 nt, Artificial Sequence
  siRNA antisense sequence
aauucuaugggugaucgau

SEQ ID NO: 1639 - RNA, 19 nt, Artificial Sequence
  siRNA sense sequence
auagaauuuccugauacug

SEQ ID NO: 1640 - RNA, 19 nt, Artificial Sequence
  siRNA antisense sequence
caguaucaggaaauucuau

SEQ ID NO: 1641 - RNA, 19 nt, Artificial Sequence
  siRNA sense sequence
agaauuuccugauacugcu

SEQ ID NO: 1642 - RNA, 19 nt, Artificial Sequence
  siRNA antisense sequence
agcaguaucaggaaauucu

SEQ ID NO: 1643 - RNA, 19 nt, Artificial Sequence
  siRNA sense sequence
cugauacugcugauuuucu

SEQ ID NO: 1644 - RNA, 19 nt, Artificial Sequence
  siRNA antisense sequence
agaaaaucagcaguaucag

SEQ ID NO: 1645 - RNA, 19 nt, Artificial Sequence
  siRNA sense sequence
ugauacugcugauuuucuu

SEQ ID NO: 1646 - RNA, 19 nt, Artificial Sequence
  siRNA antisense sequence
aagaaaaucagcaguauca

SEQ ID NO: 1647 - RNA, 19 nt, Artificial Sequence
  siRNA sense sequence
gauacugcugauuuucuua

SEQ ID NO: 1648 - RNA, 19 nt, Artificial Sequence
  siRNA antisense sequence
uaagaaaaucagcaguauc

SEQ ID NO: 1649 - RNA, 19 nt, Artificial Sequence
  siRNA sense sequence
gcugauuuucuuaauaagc

SEQ ID NO: 1650 - RNA, 19 nt, Artificial Sequence
  siRNA antisense sequence
gcuuauuaagaaaaucagc

SEQ ID NO: 1651 - RNA, 19 nt, Artificial Sequence
  siRNA sense sequence
cugauuuucuuaauaagcc

SEQ ID NO: 1652 - RNA, 19 nt, Artificial Sequence
  siRNA antisense sequence
ggcuuauuaagaaaaucag

SEQ ID NO: 1653 - RNA, 19 nt, Artificial Sequence
  siRNA sense sequence
uuucuuaauaagccaagcg

SEQ ID NO: 1654 - RNA, 19 nt, Artificial Sequence
  siRNA antisense sequence
cgcuuggcuuauuaagaaa

SEQ ID NO: 1655 - RNA, 19 nt, Artificial Sequence
  siRNA sense sequence
ucuuaauaagccaagcguu

SEQ ID NO: 1656 - RNA, 19 nt, Artificial Sequence
  siRNA antisense sequence
aacgcuuggcuuauuaaga

SEQ ID NO: 1657 - RNA, 19 nt, Artificial Sequence
  siRNA sense sequence
cuuaauaagccaagcguua

SEQ ID NO: 1658 - RNA, 19 nt, Artificial Sequence
  siRNA antisense sequence
uaacgcuuggcuuauuaag

SEQ ID NO: 1659 - RNA, 19 nt, Artificial Sequence
  siRNA sense sequence
aucucugggcaaugcaccu

SEQ ID NO: 1660 - RNA, 19 nt, Artificial Sequence
  siRNA antisense sequence
aggugcauugcccagagau

SEQ ID NO: 1661 - RNA, 19 nt, Artificial Sequence
  siRNA sense sequence
ucucugggcaaugcaccua

SEQ ID NO: 1662 - RNA, 19 nt, Artificial Sequence
  siRNA antisense sequence
uaggugcauugcccagaga

SEQ ID NO: 1663 - RNA, 19 nt, Artificial Sequence
  siRNA sense sequence
cucugggcaaugcaccuaa

SEQ ID NO: 1664 - RNA, 19 nt, Artificial Sequence
  siRNA antisense sequence
uuaggugcauugcccagag

SEQ ID NO: 1665 - RNA, 19 nt, Artificial Sequence
  siRNA sense sequence
ucugggcaaugcaccuaau

SEQ ID NO: 1666 - RNA, 19 nt, Artificial Sequence
  siRNA antisense sequence
auuaggugcauugcccaga

SEQ ID NO: 1667 - RNA, 19 nt, Artificial Sequence
  siRNA sense sequence
cugggcaaugcaccuaaua

SEQ ID NO: 1668 - RNA, 19 nt, Artificial Sequence
  siRNA antisense sequence
uauuaggugcauugcccag

SEQ ID NO: 1669 - RNA, 19 nt, Artificial Sequence
  siRNA sense sequence
ugggcaaugcaccuaauac

SEQ ID NO: 1670 - RNA, 19 nt, Artificial Sequence
  siRNA antisense sequence
guauuaggugcauugccca

SEQ ID NO: 1671 - RNA, 19 nt, Artificial Sequence
  siRNA sense sequence
gggcaaugcaccuaauacu

SEQ ID NO: 1672 - RNA, 19 nt, Artificial Sequence
  siRNA antisense sequence
aguauuaggugcauugccc

SEQ ID NO: 1673 - RNA, 19 nt, Artificial Sequence
  siRNA sense sequence
ugcaccuaauacuccagau

SEQ ID NO: 1674 - RNA, 19 nt, Artificial Sequence
  siRNA antisense sequence
aucuggaguauuaggugca

SEQ ID NO: 1675 - RNA, 19 nt, Artificial Sequence
  siRNA sense sequence
gcaccuaauacuccagauu

SEQ ID NO: 1676 - RNA, 19 nt, Artificial Sequence
  siRNA antisense sequence
aaucuggaguauuaggugc

SEQ ID NO: 1677 - RNA, 19 nt, Artificial Sequence
  siRNA sense sequence
caccuaauacuccagauuu

SEQ ID NO: 1678 - RNA, 19 nt, Artificial Sequence
  siRNA antisense sequence
aaaucuggaguauuaggug

SEQ ID NO: 1679 - RNA, 19 nt, Artificial Sequence
  siRNA sense sequence
accuaauacuccagauuuu

SEQ ID NO: 1680 - RNA, 19 nt, Artificial Sequence
  siRNA antisense sequence
aaaaucuggaguauuaggu

SEQ ID NO: 1681 - RNA, 19 nt, Artificial Sequence
  siRNA sense sequence
aaauucugauagcaaucug

SEQ ID NO: 1682 - RNA, 19 nt, Artificial Sequence
  siRNA antisense sequence
cagauugcuaucagaauuu

SEQ ID NO: 1683 - RNA, 19 nt, Artificial Sequence
  siRNA sense sequence
aauucugauagcaaucugu

SEQ ID NO: 1684 - RNA, 19 nt, Artificial Sequence
  siRNA antisense sequence
acagauugcuaucagaauu

SEQ ID NO: 1685 - RNA, 19 nt, Artificial Sequence
  siRNA sense sequence
auucugauagcaaucugug

SEQ ID NO: 1686 - RNA, 19 nt, Artificial Sequence
  siRNA antisense sequence
cacagauugcuaucagaau

SEQ ID NO: 1687 - RNA, 19 nt, Artificial Sequence
  siRNA sense sequence
uucugauagcaaucugugu

SEQ ID NO: 1688 - RNA, 19 nt, Artificial Sequence
  siRNA antisense sequence
acacagauugcuaucagaa

SEQ ID NO: 1689 - RNA, 19 nt, Artificial Sequence
  siRNA sense sequence
ucugauagcaaucugugua

SEQ ID NO: 1690 - RNA, 19 nt, Artificial Sequence
  siRNA antisense sequence
uacacagauugcuaucaga

SEQ ID NO: 1691 - RNA, 19 nt, Artificial Sequence
  siRNA sense sequence
cugauagcaaucuguguaa

SEQ ID NO: 1692 - RNA, 19 nt, Artificial Sequence
  siRNA antisense sequence
uuacacagauugcuaucag

SEQ ID NO: 1693 - RNA, 19 nt, Artificial Sequence
  siRNA sense sequence
ugauagcaaucuguguaac

SEQ ID NO: 1694 - RNA, 19 nt, Artificial Sequence
  siRNA antisense sequence
guuacacagauugcuauca

SEQ ID NO: 1695 - RNA, 19 nt, Artificial Sequence
  siRNA sense sequence
acagcuguggacaucaaau

SEQ ID NO: 1696 - RNA, 19 nt, Artificial Sequence
  siRNA antisense sequence
auuugauguccacagcugu

SEQ ID NO: 1697 - RNA, 19 nt, Artificial Sequence
  siRNA sense sequence
cagcuguggacaucaaaug

SEQ ID NO: 1698 - RNA, 19 nt, Artificial Sequence
  siRNA antisense sequence
cauuugauguccacagcug

SEQ ID NO: 1699 - RNA, 19 nt, Artificial Sequence
  siRNA sense sequence
agcuguggacaucaaaugc

SEQ ID NO: 1700 - RNA, 19 nt, Artificial Sequence
  siRNA antisense sequence
gcauuugauguccacagcu

SEQ ID NO: 1701 - RNA, 19 nt, Artificial Sequence
  siRNA sense sequence
cuguggacaucaaaugcug

SEQ ID NO: 1702 - RNA, 19 nt, Artificial Sequence
  siRNA antisense sequence
cagcauuugauguccacag

SEQ ID NO: 1703 - RNA, 19 nt, Artificial Sequence
  siRNA sense sequence
uguggacaucaaaugcuga

SEQ ID NO: 1704 - RNA, 19 nt, Artificial Sequence
  siRNA antisense sequence
ucagcauuugauguccaca

SEQ ID NO: 1705 - RNA, 19 nt, Artificial Sequence
  siRNA sense sequence
guggacaucaaaugcugaa

SEQ ID NO: 1706 - RNA, 19 nt, Artificial Sequence
  siRNA antisense sequence
uucagcauuugauguccac

SEQ ID NO: 1707 - RNA, 19 nt, Artificial Sequence
  siRNA sense sequence
acagauugcugcaguggaa

SEQ ID NO: 1708 - RNA, 19 nt, Artificial Sequence
  siRNA antisense sequence
uuccacugcagcaaucugu

SEQ ID NO: 1709 - RNA, 19 nt, Artificial Sequence
  siRNA sense sequence
aaaaucaggugaagaagaa

SEQ ID NO: 1710 - RNA, 19 nt, Artificial Sequence
  siRNA antisense sequence
uucuucuucaccugauuuu

SEQ ID NO: 1711 - RNA, 19 nt, Artificial Sequence
  siRNA sense sequence
aauuauuucaggaagguga

SEQ ID NO: 1712 - RNA, 19 nt, Artificial Sequence
  siRNA antisense sequence
ucaccuuccugaaauaauu

SEQ ID NO: 1713 - RNA, 19 nt, Artificial Sequence
  siRNA sense sequence
auuauuucaggaaggugau

SEQ ID NO: 1714 - RNA, 19 nt, Artificial Sequence
  siRNA antisense sequence
aucaccuuccugaaauaau

SEQ ID NO: 1715 - RNA, 19 nt, Artificial Sequence
  siRNA sense sequence
uuauuucaggaaggugaua

SEQ ID NO: 1716 - RNA, 19 nt, Artificial Sequence
  siRNA antisense sequence
uaucaccuuccugaaauaa

SEQ ID NO: 1717 - RNA, 19 nt, Artificial Sequence
  siRNA sense sequence
uuucaggaaggugauaagu

SEQ ID NO: 1718 - RNA, 19 nt, Artificial Sequence
  siRNA antisense sequence
acuuaucaccuuccugaaa

SEQ ID NO: 1719 - RNA, 19 nt, Artificial Sequence
  siRNA sense sequence
uucaggaaggugauaagug

SEQ ID NO: 1720 - RNA, 19 nt, Artificial Sequence
  siRNA antisense sequence
cacuuaucaccuuccugaa

SEQ ID NO: 1721 - RNA, 19 nt, Artificial Sequence
  siRNA sense sequence
ucaggaaggugauaagugg

SEQ ID NO: 1722 - RNA, 19 nt, Artificial Sequence
  siRNA antisense sequence
ccacuuaucaccuuccuga

SEQ ID NO: 1723 - RNA, 19 nt, Artificial Sequence
  siRNA sense sequence
gaaggugauaaguggcuaa

SEQ ID NO: 1724 - RNA, 19 nt, Artificial Sequence
  siRNA antisense sequence
uuagccacuuaucaccuuc

SEQ ID NO: 1725 - RNA, 19 nt, Artificial Sequence
  siRNA sense sequence
aaggugauaaguggcuaac

SEQ ID NO: 1726 - RNA, 19 nt, Artificial Sequence
  siRNA antisense sequence
guuagccacuuaucaccuu

SEQ ID NO: 1727 - RNA, 19 nt, Artificial Sequence
  siRNA sense sequence
agaagaggcacagagugaa

SEQ ID NO: 1728 - RNA, 19 nt, Artificial Sequence
  siRNA antisense sequence
uucacucugugccucuucu

SEQ ID NO: 1729 - RNA, 19 nt, Artificial Sequence
  siRNA sense sequence
ggaaguaucacuggaccug

SEQ ID NO: 1730 - RNA, 19 nt, Artificial Sequence
  siRNA antisense sequence
cagguccagugauacuucc

SEQ ID NO: 1731 - RNA, 19 nt, Artificial Sequence
  siRNA sense sequence
gaaguaucacuggaccuga

SEQ ID NO: 1732 - RNA, 19 nt, Artificial Sequence
  siRNA antisense sequence
ucagguccagugauacuuc

SEQ ID NO: 1733 - RNA, 19 nt, Artificial Sequence
  siRNA sense sequence
ucacuggaccugauuuuag

SEQ ID NO: 1734 - RNA, 19 nt, Artificial Sequence
  siRNA antisense sequence
cuaaaaucagguccaguga

SEQ ID NO: 1735 - RNA, 19 nt, Artificial Sequence
  siRNA sense sequence
cacuggaccugauuuuagu

SEQ ID NO: 1736 - RNA, 19 nt, Artificial Sequence
  siRNA antisense sequence
acuaaaaucagguccagug

SEQ ID NO: 1737 - RNA, 19 nt, Artificial Sequence
  siRNA sense sequence
acuggaccugauuuuagua

SEQ ID NO: 1738 - RNA, 19 nt, Artificial Sequence
  siRNA antisense sequence
uacuaaaaucagguccagu

SEQ ID NO: 1739 - RNA, 19 nt, Artificial Sequence
  siRNA sense sequence
cuggaccugauuuuaguag

SEQ ID NO: 1740 - RNA, 19 nt, Artificial Sequence
  siRNA antisense sequence
cuacuaaaaucagguccag

SEQ ID NO: 1741 - RNA, 19 nt, Artificial Sequence
  siRNA sense sequence
uggaccugauuuuaguaga

SEQ ID NO: 1742 - RNA, 19 nt, Artificial Sequence
  siRNA antisense sequence
ucuacuaaaaucaggucca

SEQ ID NO: 1743 - RNA, 19 nt, Artificial Sequence
  siRNA sense sequence
ggaccugauuuuaguagaa

SEQ ID NO: 1744 - RNA, 19 nt, Artificial Sequence
  siRNA antisense sequence
uucuacuaaaaucaggucc

SEQ ID NO: 1745 - RNA, 19 nt, Artificial Sequence
  siRNA sense sequence
gaccugauuuuaguagaag

SEQ ID NO: 1746 - RNA, 19 nt, Artificial Sequence
  siRNA antisense sequence
cuucuacuaaaaucagguc

SEQ ID NO: 1747 - RNA, 19 nt, Artificial Sequence
  siRNA sense sequence
accugauuuuaguagaaga

SEQ ID NO: 1748 - RNA, 19 nt, Artificial Sequence
  siRNA antisense sequence
ucuucuacuaaaaucaggu

SEQ ID NO: 1749 - RNA, 19 nt, Artificial Sequence
  siRNA sense sequence
ccugauuuuaguagaagag

SEQ ID NO: 1750 - RNA, 19 nt, Artificial Sequence
  siRNA antisense sequence
cucuucuacuaaaaucagg

SEQ ID NO: 1751 - RNA, 19 nt, Artificial Sequence
  siRNA sense sequence
cugauuuuaguagaagagu

SEQ ID NO: 1752 - RNA, 19 nt, Artificial Sequence
  siRNA antisense sequence
acucuucuacuaaaaucag

SEQ ID NO: 1753 - RNA, 19 nt, Artificial Sequence
  siRNA sense sequence
uuuaguagaagaguaugac

SEQ ID NO: 1754 - RNA, 19 nt, Artificial Sequence
  siRNA antisense sequence
gucauacucuucuacuaaa

SEQ ID NO: 1755 - RNA, 19 nt, Artificial Sequence
  siRNA sense sequence
uuaguagaagaguaugacu

SEQ ID NO: 1756 - RNA, 19 nt, Artificial Sequence
  siRNA antisense sequence
agucauacucuucuacuaa

SEQ ID NO: 1757 - RNA, 19 nt, Artificial Sequence
  siRNA sense sequence
ugagcaacuggaauuuucc

SEQ ID NO: 1758 - RNA, 19 nt, Artificial Sequence
  siRNA antisense sequence
ggaaaauuccaguugcuca

SEQ ID NO: 1759 - RNA, 19 nt, Artificial Sequence
  siRNA sense sequence
aucaggaaggauucucagu

SEQ ID NO: 1760 - RNA, 19 nt, Artificial Sequence
  siRNA antisense sequence
acugagaauccuuccugau

SEQ ID NO: 1761 - RNA, 19 nt, Artificial Sequence
  siRNA sense sequence
ucaggaaggauucucaguc

SEQ ID NO: 1762 - RNA, 19 nt, Artificial Sequence
  siRNA antisense sequence
gacugagaauccuuccuga

SEQ ID NO: 1763 - RNA, 19 nt, Artificial Sequence
  siRNA sense sequence
caggaaggauucucaguca

SEQ ID NO: 1764 - RNA, 19 nt, Artificial Sequence
  siRNA antisense sequence
ugacugagaauccuuccug

SEQ ID NO: 1765 - RNA, 19 nt, Artificial Sequence
  siRNA sense sequence
gauucucagucagguuaug

SEQ ID NO: 1766 - RNA, 19 nt, Artificial Sequence
  siRNA antisense sequence
cauaaccugacugagaauc

SEQ ID NO: 1767 - RNA, 19 nt, Artificial Sequence
  siRNA sense sequence
auucucagucagguuaugu

SEQ ID NO: 1768 - RNA, 19 nt, Artificial Sequence
  siRNA antisense sequence
acauaaccugacugagaau

SEQ ID NO: 1769 - RNA, 19 nt, Artificial Sequence
  siRNA sense sequence
uucucagucagguuaugua

SEQ ID NO: 1770 - RNA, 19 nt, Artificial Sequence
  siRNA antisense sequence
uacauaaccugacugagaa

SEQ ID NO: 1771 - RNA, 19 nt, Artificial Sequence
  siRNA sense sequence
ucucagucagguuauguau

SEQ ID NO: 1772 - RNA, 19 nt, Artificial Sequence
  siRNA antisense sequence
auacauaaccugacugaga

SEQ ID NO: 1773 - RNA, 19 nt, Artificial Sequence
  siRNA sense sequence
uaccuuauuucaagacacu

SEQ ID NO: 1774 - RNA, 19 nt, Artificial Sequence
  siRNA antisense sequence
agugucuugaaauaaggua

SEQ ID NO: 1775 - RNA, 19 nt, Artificial Sequence
  siRNA sense sequence
accuuauuucaagacacug

SEQ ID NO: 1776 - RNA, 19 nt, Artificial Sequence
  siRNA antisense sequence
cagugucuugaaauaaggu

SEQ ID NO: 1777 - RNA, 19 nt, Artificial Sequence
  siRNA sense sequence
uauuucaagacacugguuu

SEQ ID NO: 1778 - RNA, 19 nt, Artificial Sequence
  siRNA antisense sequence
aaaccagugucuugaaaua

SEQ ID NO: 1779 - RNA, 19 nt, Artificial Sequence
  siRNA sense sequence
auuucaagacacugguuua

SEQ ID NO: 1780 - RNA, 19 nt, Artificial Sequence
  siRNA antisense sequence
uaaaccagugucuugaaau

SEQ ID NO: 1781 - RNA, 19 nt, Artificial Sequence
  siRNA sense sequence
uuucaagacacugguuuau

SEQ ID NO: 1782 - RNA, 19 nt, Artificial Sequence
  siRNA antisense sequence
auaaaccagugucuugaaa

SEQ ID NO: 1783 - RNA, 19 nt, Artificial Sequence
  siRNA sense sequence
uucaagacacugguuuauu

SEQ ID NO: 1784 - RNA, 19 nt, Artificial Sequence
  siRNA antisense sequence
aauaaaccagugucuugaa

SEQ ID NO: 1785 - RNA, 19 nt, Artificial Sequence
  siRNA sense sequence
ucaagacacugguuuauug

SEQ ID NO: 1786 - RNA, 19 nt, Artificial Sequence
  siRNA antisense sequence
caauaaaccagugucuuga

SEQ ID NO: 1787 - RNA, 19 nt, Artificial Sequence
  siRNA sense sequence
cuauuuucgugcauuagaa

SEQ ID NO: 1788 - RNA, 19 nt, Artificial Sequence
  siRNA antisense sequence
uucuaaugcacgaaaauag

SEQ ID NO: 1789 - RNA, 19 nt, Artificial Sequence
  siRNA sense sequence
caaucguauacaugccaca

SEQ ID NO: 1790 - RNA, 19 nt, Artificial Sequence
  siRNA antisense sequence
uguggcauguauacgauug

SEQ ID NO: 1791 - RNA, 19 nt, Artificial Sequence
  siRNA sense sequence
cguauacaugccacagaug

SEQ ID NO: 1792 - RNA, 19 nt, Artificial Sequence
  siRNA antisense sequence
caucuguggcauguauacg

SEQ ID NO: 1793 - RNA, 19 nt, Artificial Sequence
  siRNA sense sequence
caugccacagaugugcuac

SEQ ID NO: 1794 - RNA, 19 nt, Artificial Sequence
  siRNA antisense sequence
guagcacaucuguggcaug

SEQ ID NO: 1795 - RNA, 19 nt, Artificial Sequence
  siRNA sense sequence
augccacagaugugcuaca

SEQ ID NO: 1796 - RNA, 19 nt, Artificial Sequence
  siRNA antisense sequence
uguagcacaucuguggcau

SEQ ID NO: 1797 - RNA, 19 nt, Artificial Sequence
  siRNA sense sequence
ugugcuacaugcaguuugg

SEQ ID NO: 1798 - RNA, 19 nt, Artificial Sequence
  siRNA antisense sequence
ccaaacugcauguagcaca

SEQ ID NO: 1799 - RNA, 19 nt, Artificial Sequence
  siRNA sense sequence
gugcuacaugcaguuuggu

SEQ ID NO: 1800 - RNA, 19 nt, Artificial Sequence
  siRNA antisense sequence
accaaacugcauguagcac

SEQ ID NO: 1801 - RNA, 19 nt, Artificial Sequence
  siRNA sense sequence
gcuacaugcaguuugguau

SEQ ID NO: 1802 - RNA, 19 nt, Artificial Sequence
  siRNA antisense sequence
auaccaaacugcauguagc

SEQ ID NO: 1803 - RNA, 19 nt, Artificial Sequence
  siRNA sense sequence
uacaugcaguuugguaucu

SEQ ID NO: 1804 - RNA, 19 nt, Artificial Sequence
  siRNA antisense sequence
agauaccaaacugcaugua

SEQ ID NO: 1805 - RNA, 19 nt, Artificial Sequence
  siRNA sense sequence
acaugcaguuugguaucug

SEQ ID NO: 1806 - RNA, 19 nt, Artificial Sequence
  siRNA antisense sequence
cagauaccaaacugcaugu

SEQ ID NO: 1807 - RNA, 19 nt, Artificial Sequence
  siRNA sense sequence
caugcaguuugguaucuga

SEQ ID NO: 1808 - RNA, 19 nt, Artificial Sequence
  siRNA antisense sequence
ucagauaccaaacugcaug

SEQ ID NO: 1809 - RNA, 19 nt, Artificial Sequence
  siRNA sense sequence
augcaguuugguaucugac

SEQ ID NO: 1810 - RNA, 19 nt, Artificial Sequence
  siRNA antisense sequence
gucagauaccaaacugcau

SEQ ID NO: 1811 - RNA, 19 nt, Artificial Sequence
  siRNA sense sequence
caguuccuggcuuacagca

SEQ ID NO: 1812 - RNA, 19 nt, Artificial Sequence
  siRNA antisense sequence
ugcuguaagccaggaacug

SEQ ID NO: 1813 - RNA, 19 nt, Artificial Sequence
  siRNA sense sequence
uccuggcuuacagcagauc

SEQ ID NO: 1814 - RNA, 19 nt, Artificial Sequence
  siRNA antisense sequence
gaucugcuguaagccagga

SEQ ID NO: 1815 - RNA, 19 nt, Artificial Sequence
  siRNA sense sequence
ccuggcuuacagcagaucc

SEQ ID NO: 1816 - RNA, 19 nt, Artificial Sequence
  siRNA antisense sequence
ggaucugcuguaagccagg

SEQ ID NO: 1817 - RNA, 19 nt, Artificial Sequence
  siRNA sense sequence
cuggcuuacagcagaucca

SEQ ID NO: 1818 - RNA, 19 nt, Artificial Sequence
  siRNA antisense sequence
uggaucugcuguaagccag

SEQ ID NO: 1819 - RNA, 19 nt, Artificial Sequence
  siRNA sense sequence
uggcuuacagcagauccac

SEQ ID NO: 1820 - RNA, 19 nt, Artificial Sequence
  siRNA antisense sequence
guggaucugcuguaagcca

SEQ ID NO: 1821 - RNA, 19 nt, Artificial Sequence
  siRNA sense sequence
ggcuuacagcagauccaca

SEQ ID NO: 1822 - RNA, 19 nt, Artificial Sequence
  siRNA antisense sequence
uguggaucugcuguaagcc

SEQ ID NO: 1823 - RNA, 19 nt, Artificial Sequence
  siRNA sense sequence
ucugaugguagaauuaacc

SEQ ID NO: 1824 - RNA, 19 nt, Artificial Sequence
  siRNA antisense sequence
gguuaauucuaccaucaga

SEQ ID NO: 1825 - RNA, 19 nt, Artificial Sequence
  siRNA sense sequence
gguagaauuaaccaugggc

SEQ ID NO: 1826 - RNA, 19 nt, Artificial Sequence
  siRNA antisense sequence
gcccaugguuaauucuacc

SEQ ID NO: 1827 - RNA, 19 nt, Artificial Sequence
  siRNA sense sequence
guagaauuaaccaugggcg

SEQ ID NO: 1828 - RNA, 19 nt, Artificial Sequence
  siRNA antisense sequence
cgcccaugguuaauucuac

SEQ ID NO: 1829 - RNA, 19 nt, Artificial Sequence
  siRNA sense sequence
uagaauuaaccaugggcga

SEQ ID NO: 1830 - RNA, 19 nt, Artificial Sequence
  siRNA antisense sequence
ucgcccaugguuaauucua

SEQ ID NO: 1831 - RNA, 19 nt, Artificial Sequence
  siRNA sense sequence
agaauuaaccaugggcgaa

SEQ ID NO: 1832 - RNA, 19 nt, Artificial Sequence
  siRNA antisense sequence
uucgcccaugguuaauucu

SEQ ID NO: 1833 - RNA, 19 nt, Artificial Sequence
  siRNA sense sequence
gaauuaaccaugggcgaau

SEQ ID NO: 1834 - RNA, 19 nt, Artificial Sequence
  siRNA antisense sequence
auucgcccaugguuaauuc

SEQ ID NO: 1835 - RNA, 19 nt, Artificial Sequence
  siRNA sense sequence
auuaaccaugggcgaauug

SEQ ID NO: 1836 - RNA, 19 nt, Artificial Sequence
  siRNA antisense sequence
caauucgcccaugguuaau

SEQ ID NO: 1837 - RNA, 19 nt, Artificial Sequence
  siRNA sense sequence
uuaaccaugggcgaauugc

SEQ ID NO: 1838 - RNA, 19 nt, Artificial Sequence
  siRNA antisense sequence
gcaauucgcccaugguuaa

SEQ ID NO: 1839 - RNA, 19 nt, Artificial Sequence
  siRNA sense sequence
uaaccaugggcgaauugcu

SEQ ID NO: 1840 - RNA, 19 nt, Artificial Sequence
  siRNA antisense sequence
agcaauucgcccaugguua

SEQ ID NO: 1841 - RNA, 19 nt, Artificial Sequence
  siRNA sense sequence
aaccaugggcgaauugcuu

SEQ ID NO: 1842 - RNA, 19 nt, Artificial Sequence
  siRNA antisense sequence
aagcaauucgcccaugguu

SEQ ID NO: 1843 - RNA, 19 nt, Artificial Sequence
  siRNA sense sequence
accaugggcgaauugcuua

SEQ ID NO: 1844 - RNA, 19 nt, Artificial Sequence
  siRNA antisense sequence
uaagcaauucgcccauggu

SEQ ID NO: 1845 - RNA, 19 nt, Artificial Sequence
  siRNA sense sequence
ccaugggcgaauugcuuau

SEQ ID NO: 1846 - RNA, 19 nt, Artificial Sequence
  siRNA antisense sequence
auaagcaauucgcccaugg

SEQ ID NO: 1847 - RNA, 19 nt, Artificial Sequence
  siRNA sense sequence
caugggcgaauugcuuaua

SEQ ID NO: 1848 - RNA, 19 nt, Artificial Sequence
  siRNA antisense sequence
uauaagcaauucgcccaug

SEQ ID NO: 1849 - RNA, 19 nt, Artificial Sequence
  siRNA sense sequence
ggcgaauugcuuauauuuc

SEQ ID NO: 1850 - RNA, 19 nt, Artificial Sequence
  siRNA antisense sequence
gaaauauaagcaauucgcc

SEQ ID NO: 1851 - RNA, 19 nt, Artificial Sequence
  siRNA sense sequence
gcgaauugcuuauauuucu

SEQ ID NO: 1852 - RNA, 19 nt, Artificial Sequence
  siRNA antisense sequence
agaaauauaagcaauucgc

SEQ ID NO: 1853 - RNA, 19 nt, Artificial Sequence
  siRNA sense sequence
ugcuuauauuucuucgaag

SEQ ID NO: 1854 - RNA, 19 nt, Artificial Sequence
  siRNA antisense sequence
cuucgaagaaauauaagca

SEQ ID NO: 1855 - RNA, 19 nt, Artificial Sequence
  siRNA sense sequence
gcuuauauuucuucgaaga

SEQ ID NO: 1856 - RNA, 19 nt, Artificial Sequence
  siRNA antisense sequence
ucuucgaagaaauauaagc

SEQ ID NO: 1857 - RNA, 19 nt, Artificial Sequence
  siRNA sense sequence
cuuauauuucuucgaagag

SEQ ID NO: 1858 - RNA, 19 nt, Artificial Sequence
  siRNA antisense sequence
cucuucgaagaaauauaag

SEQ ID NO: 1859 - RNA, 19 nt, Artificial Sequence
  siRNA sense sequence
uauauuucuucgaagagcu

SEQ ID NO: 1860 - RNA, 19 nt, Artificial Sequence
  siRNA antisense sequence
agcucuucgaagaaauaua

SEQ ID NO: 1861 - RNA, 19 nt, Artificial Sequence
  siRNA sense sequence
auauuucuucgaagagcug

SEQ ID NO: 1862 - RNA, 19 nt, Artificial Sequence
  siRNA antisense sequence
cagcucuucgaagaaauau

SEQ ID NO: 1863 - RNA, 19 nt, Artificial Sequence
  siRNA sense sequence
uauuucuucgaagagcugc

SEQ ID NO: 1864 - RNA, 19 nt, Artificial Sequence
  siRNA antisense sequence
gcagcucuucgaagaaaua

SEQ ID NO: 1865 - RNA, 19 nt, Artificial Sequence
  siRNA sense sequence
gagcugcucuaauccugau

SEQ ID NO: 1866 - RNA, 19 nt, Artificial Sequence
  siRNA antisense sequence
aucaggauuagagcagcuc

SEQ ID NO: 1867 - RNA, 19 nt, Artificial Sequence
  siRNA sense sequence
agcugcucuaauccugaug

SEQ ID NO: 1868 - RNA, 19 nt, Artificial Sequence
  siRNA antisense sequence
caucaggauuagagcagcu

SEQ ID NO: 1869 - RNA, 19 nt, Artificial Sequence
  siRNA sense sequence
gcugcucuaauccugauga

SEQ ID NO: 1870 - RNA, 19 nt, Artificial Sequence
  siRNA antisense sequence
ucaucaggauuagagcagc

SEQ ID NO: 1871 - RNA, 19 nt, Artificial Sequence
  siRNA sense sequence
cugcucuaauccugaugag

SEQ ID NO: 1872 - RNA, 19 nt, Artificial Sequence
  siRNA antisense sequence
cucaucaggauuagagcag

SEQ ID NO: 1873 - RNA, 19 nt, Artificial Sequence
  siRNA sense sequence
agaguuauggcugccuguc

SEQ ID NO: 1874 - RNA, 19 nt, Artificial Sequence
  siRNA antisense sequence
gacaggcagccauaacucu

SEQ ID NO: 1875 - RNA, 19 nt, Artificial Sequence
  siRNA sense sequence
gaguuauggcugccugucu

SEQ ID NO: 1876 - RNA, 19 nt, Artificial Sequence
  siRNA antisense sequence
agacaggcagccauaacuc

SEQ ID NO: 1877 - RNA, 19 nt, Artificial Sequence
  siRNA sense sequence
aguuauggcugccugucuu

SEQ ID NO: 1878 - RNA, 19 nt, Artificial Sequence
  siRNA antisense sequence
aagacaggcagccauaacu

SEQ ID NO: 1879 - RNA, 19 nt, Artificial Sequence
  siRNA sense sequence
guuauggcugccugucuuc

SEQ ID NO: 1880 - RNA, 19 nt, Artificial Sequence
  siRNA antisense sequence
gaagacaggcagccauaac

SEQ ID NO: 1881 - RNA, 19 nt, Artificial Sequence
  siRNA sense sequence
uuccugcauuagaauugau

SEQ ID NO: 1882 - RNA, 19 nt, Artificial Sequence
  siRNA antisense sequence
aucaauucuaaugcaggaa

SEQ ID NO: 1883 - RNA, 19 nt, Artificial Sequence
  siRNA sense sequence
uccugcauuagaauugaug

SEQ ID NO: 1884 - RNA, 19 nt, Artificial Sequence
  siRNA antisense sequence
caucaauucuaaugcagga

SEQ ID NO: 1885 - RNA, 19 nt, Artificial Sequence
  siRNA sense sequence
ccugcauuagaauugaugg

SEQ ID NO: 1886 - RNA, 19 nt, Artificial Sequence
  siRNA antisense sequence
ccaucaauucuaaugcagg

SEQ ID NO: 1887 - RNA, 19 nt, Artificial Sequence
  siRNA sense sequence
cugcauuagaauugauggc

SEQ ID NO: 1888 - RNA, 19 nt, Artificial Sequence
  siRNA antisense sequence
gccaucaauucuaaugcag

SEQ ID NO: 1889 - RNA, 19 nt, Artificial Sequence
  siRNA sense sequence
ugcauuagaauugauggcu

SEQ ID NO: 1890 - RNA, 19 nt, Artificial Sequence
  siRNA antisense sequence
agccaucaauucuaaugca

SEQ ID NO: 1891 - RNA, 19 nt, Artificial Sequence
  siRNA sense sequence
gcauuagaauugauggcuc

SEQ ID NO: 1892 - RNA, 19 nt, Artificial Sequence
  siRNA antisense sequence
gagccaucaauucuaaugc

SEQ ID NO: 1893 - RNA, 19 nt, Artificial Sequence
  siRNA sense sequence
cauuagaauugauggcucu

SEQ ID NO: 1894 - RNA, 19 nt, Artificial Sequence
  siRNA antisense sequence
agagccaucaauucuaaug

SEQ ID NO: 1895 - RNA, 19 nt, Artificial Sequence
  siRNA sense sequence
agaauugauggcucuauac

SEQ ID NO: 1896 - RNA, 19 nt, Artificial Sequence
  siRNA antisense sequence
guauagagccaucaauucu

SEQ ID NO: 1897 - RNA, 19 nt, Artificial Sequence
  siRNA sense sequence
gaauugauggcucuauacg

SEQ ID NO: 1898 - RNA, 19 nt, Artificial Sequence
  siRNA antisense sequence
cguauagagccaucaauuc

SEQ ID NO: 1899 - RNA, 19 nt, Artificial Sequence
  siRNA sense sequence
aauugauggcucuauacgu

SEQ ID NO: 1900 - RNA, 19 nt, Artificial Sequence
  siRNA antisense sequence
acguauagagccaucaauu

SEQ ID NO: 1901 - RNA, 19 nt, Artificial Sequence
  siRNA sense sequence
auugauggcucuauacgug

SEQ ID NO: 1902 - RNA, 19 nt, Artificial Sequence
  siRNA antisense sequence
cacguauagagccaucaau

SEQ ID NO: 1903 - RNA, 19 nt, Artificial Sequence
  siRNA sense sequence
uugauggcucuauacgugg

SEQ ID NO: 1904 - RNA, 19 nt, Artificial Sequence
  siRNA antisense sequence
ccacguauagagccaucaa

SEQ ID NO: 1905 - RNA, 19 nt, Artificial Sequence
  siRNA sense sequence
ugauggcucuauacguggc

SEQ ID NO: 1906 - RNA, 19 nt, Artificial Sequence
  siRNA antisense sequence
gccacguauagagccauca

SEQ ID NO: 1907 - RNA, 19 nt, Artificial Sequence
  siRNA sense sequence
gauggcucuauacguggca

SEQ ID NO: 1908 - RNA, 19 nt, Artificial Sequence
  siRNA antisense sequence
ugccacguauagagccauc

SEQ ID NO: 1909 - RNA, 19 nt, Artificial Sequence
  siRNA sense sequence
uggcucuauacguggcagc

SEQ ID NO: 1910 - RNA, 19 nt, Artificial Sequence
  siRNA antisense sequence
gcugccacguauagagcca

SEQ ID NO: 1911 - RNA, 19 nt, Artificial Sequence
  siRNA sense sequence
ucuauacguggcagcugcc

SEQ ID NO: 1912 - RNA, 19 nt, Artificial Sequence
  siRNA antisense sequence
ggcagcugccacguauaga

SEQ ID NO: 1913 - RNA, 19 nt, Artificial Sequence
  siRNA sense sequence
gcagcugccaugcaugauu

SEQ ID NO: 1914 - RNA, 19 nt, Artificial Sequence
  siRNA antisense sequence
aaucaugcauggcagcugc

SEQ ID NO: 1915 - RNA, 19 nt, Artificial Sequence
  siRNA sense sequence
cagcugccaugcaugauua

SEQ ID NO: 1916 - RNA, 19 nt, Artificial Sequence
  siRNA antisense sequence
uaaucaugcauggcagcug

SEQ ID NO: 1917 - RNA, 19 nt, Artificial Sequence
  siRNA sense sequence
agcugccaugcaugauuau

SEQ ID NO: 1918 - RNA, 19 nt, Artificial Sequence
  siRNA antisense sequence
auaaucaugcauggcagcu

SEQ ID NO: 1919 - RNA, 19 nt, Artificial Sequence
  siRNA sense sequence
gcugccaugcaugauuaug

SEQ ID NO: 1920 - RNA, 19 nt, Artificial Sequence
  siRNA antisense sequence
cauaaucaugcauggcagc

SEQ ID NO: 1921 - RNA, 19 nt, Artificial Sequence
  siRNA sense sequence
cugccaugcaugauuauga

SEQ ID NO: 1922 - RNA, 19 nt, Artificial Sequence
  siRNA antisense sequence
ucauaaucaugcauggcag

SEQ ID NO: 1923 - RNA, 19 nt, Artificial Sequence
  siRNA sense sequence
gauuaugaucacccaggga

SEQ ID NO: 1924 - RNA, 19 nt, Artificial Sequence
  siRNA antisense sequence
ucccugggugaucauaauc

SEQ ID NO: 1925 - RNA, 19 nt, Artificial Sequence
  siRNA sense sequence
augaucacccagggaggac

SEQ ID NO: 1926 - RNA, 19 nt, Artificial Sequence
  siRNA antisense sequence
guccucccugggugaucau

SEQ ID NO: 1927 - RNA, 19 nt, Artificial Sequence
  siRNA sense sequence
ugaucacccagggaggaca

SEQ ID NO: 1928 - RNA, 19 nt, Artificial Sequence
  siRNA antisense sequence
uguccucccugggugauca

SEQ ID NO: 1929 - RNA, 19 nt, Artificial Sequence
  siRNA sense sequence
aaaaucaucaugcugcguc

SEQ ID NO: 1930 - RNA, 19 nt, Artificial Sequence
  siRNA antisense sequence
gacgcagcaugaugauuuu

SEQ ID NO: 1931 - RNA, 19 nt, Artificial Sequence
  siRNA sense sequence
aaaucaucaugcugcguca

SEQ ID NO: 1932 - RNA, 19 nt, Artificial Sequence
  siRNA antisense sequence
ugacgcagcaugaugauuu

SEQ ID NO: 1933 - RNA, 19 nt, Artificial Sequence
  siRNA sense sequence
aaucaucaugcugcgucag

SEQ ID NO: 1934 - RNA, 19 nt, Artificial Sequence
  siRNA antisense sequence
cugacgcagcaugaugauu

SEQ ID NO: 1935 - RNA, 19 nt, Artificial Sequence
  siRNA sense sequence
cugcgucagcuuggaaucu

SEQ ID NO: 1936 - RNA, 19 nt, Artificial Sequence
  siRNA antisense sequence
agauuccaagcugacgcag

SEQ ID NO: 1937 - RNA, 19 nt, Artificial Sequence
  siRNA sense sequence
ugcgucagcuuggaaucua

SEQ ID NO: 1938 - RNA, 19 nt, Artificial Sequence
  siRNA antisense sequence
uagauuccaagcugacgca

SEQ ID NO: 1939 - RNA, 19 nt, Artificial Sequence
  siRNA sense sequence
gcgucagcuuggaaucuau

SEQ ID NO: 1940 - RNA, 19 nt, Artificial Sequence
  siRNA antisense sequence
auagauuccaagcugacgc

SEQ ID NO: 1941 - RNA, 19 nt, Artificial Sequence
  siRNA sense sequence
cgucagcuuggaaucuaua

SEQ ID NO: 1942 - RNA, 19 nt, Artificial Sequence
  siRNA antisense sequence
uauagauuccaagcugacg

SEQ ID NO: 1943 - RNA, 19 nt, Artificial Sequence
  siRNA sense sequence
gucagcuuggaaucuauau

SEQ ID NO: 1944 - RNA, 19 nt, Artificial Sequence
  siRNA antisense sequence
auauagauuccaagcugac

SEQ ID NO: 1945 - RNA, 19 nt, Artificial Sequence
  siRNA sense sequence
ucagcuuggaaucuauauc

SEQ ID NO: 1946 - RNA, 19 nt, Artificial Sequence
  siRNA antisense sequence
gauauagauuccaagcuga

SEQ ID NO: 1947 - RNA, 19 nt, Artificial Sequence
  siRNA sense sequence
cagcuuggaaucuauaucu

SEQ ID NO: 1948 - RNA, 19 nt, Artificial Sequence
  siRNA antisense sequence
agauauagauuccaagcug

SEQ ID NO: 1949 - RNA, 19 nt, Artificial Sequence
  siRNA sense sequence
agcuuggaaucuauaucuu

SEQ ID NO: 1950 - RNA, 19 nt, Artificial Sequence
  siRNA antisense sequence
aagauauagauuccaagcu

SEQ ID NO: 1951 - RNA, 19 nt, Artificial Sequence
  siRNA sense sequence
gcuuggaaucuauaucuuu

SEQ ID NO: 1952 - RNA, 19 nt, Artificial Sequence
  siRNA antisense sequence
aaagauauagauuccaagc

SEQ ID NO: 1953 - RNA, 19 nt, Artificial Sequence
  siRNA sense sequence
cuuggaaucuauaucuuuc

SEQ ID NO: 1954 - RNA, 19 nt, Artificial Sequence
  siRNA antisense sequence
gaaagauauagauuccaag

SEQ ID NO: 1955 - RNA, 19 nt, Artificial Sequence
  siRNA sense sequence
aaucuauaucuuucucgcc

SEQ ID NO: 1956 - RNA, 19 nt, Artificial Sequence
  siRNA antisense sequence
ggcgagaaagauauagauu

SEQ ID NO: 1957 - RNA, 19 nt, Artificial Sequence
  siRNA sense sequence
aucuauaucuuucucgccc

SEQ ID NO: 1958 - RNA, 19 nt, Artificial Sequence
  siRNA antisense sequence
gggcgagaaagauauagau

SEQ ID NO: 1959 - RNA, 19 nt, Artificial Sequence
  siRNA sense sequence
ucuauaucuuucucgccca

SEQ ID NO: 1960 - RNA, 19 nt, Artificial Sequence
  siRNA antisense sequence
ugggcgagaaagauauaga

SEQ ID NO: 1961 - RNA, 19 nt, Artificial Sequence
  siRNA sense sequence
cuauaucuuucucgcccag

SEQ ID NO: 1962 - RNA, 19 nt, Artificial Sequence
  siRNA antisense sequence
cugggcgagaaagauauag

SEQ ID NO: 1963 - RNA, 19 nt, Artificial Sequence
  siRNA sense sequence
uauaucuuucucgcccaga

SEQ ID NO: 1964 - RNA, 19 nt, Artificial Sequence
  siRNA antisense sequence
ucugggcgagaaagauaua

SEQ ID NO: 1965 - RNA, 19 nt, Artificial Sequence
  siRNA sense sequence
aacuuccuucuucaucuug

SEQ ID NO: 1966 - RNA, 19 nt, Artificial Sequence
  siRNA antisense sequence
caagaugaagaaggaaguu

SEQ ID NO: 1967 - RNA, 19 nt, Artificial Sequence
  siRNA sense sequence
acuuccuucuucaucuuga

SEQ ID NO: 1968 - RNA, 19 nt, Artificial Sequence
  siRNA antisense sequence
ucaagaugaagaaggaagu

SEQ ID NO: 1969 - RNA, 19 nt, Artificial Sequence
  siRNA sense sequence
cuuccuucuucaucuugau

SEQ ID NO: 1970 - RNA, 19 nt, Artificial Sequence
  siRNA antisense sequence
aucaagaugaagaaggaag

SEQ ID NO: 1971 - RNA, 19 nt, Artificial Sequence
  siRNA sense sequence
uuccuucuucaucuugauc

SEQ ID NO: 1972 - RNA, 19 nt, Artificial Sequence
  siRNA antisense sequence
gaucaagaugaagaaggaa

SEQ ID NO: 1973 - RNA, 19 nt, Artificial Sequence
  siRNA sense sequence
uccuucuucaucuugauca

SEQ ID NO: 1974 - RNA, 19 nt, Artificial Sequence
  siRNA antisense sequence
ugaucaagaugaagaagga

SEQ ID NO: 1975 - RNA, 19 nt, Artificial Sequence
  siRNA sense sequence
ccuucuucaucuugaucau

SEQ ID NO: 1976 - RNA, 19 nt, Artificial Sequence
  siRNA antisense sequence
augaucaagaugaagaagg

SEQ ID NO: 1977 - RNA, 19 nt, Artificial Sequence
  siRNA sense sequence
cuucuucaucuugaucaug

SEQ ID NO: 1978 - RNA, 19 nt, Artificial Sequence
  siRNA antisense sequence
caugaucaagaugaagaag

SEQ ID NO: 1979 - RNA, 19 nt, Artificial Sequence
  siRNA sense sequence
cuucaucuugaucaugugg

SEQ ID NO: 1980 - RNA, 19 nt, Artificial Sequence
  siRNA antisense sequence
ccacaugaucaagaugaag

SEQ ID NO: 1981 - RNA, 19 nt, Artificial Sequence
  siRNA sense sequence
uucaucuugaucaugugga

SEQ ID NO: 1982 - RNA, 19 nt, Artificial Sequence
  siRNA antisense sequence
uccacaugaucaagaugaa

SEQ ID NO: 1983 - RNA, 19 nt, Artificial Sequence
  siRNA sense sequence
ucaucuugaucauguggaa

SEQ ID NO: 1984 - RNA, 19 nt, Artificial Sequence
  siRNA antisense sequence
uuccacaugaucaagauga

SEQ ID NO: 1985 - RNA, 19 nt, Artificial Sequence
  siRNA sense sequence
caucuugaucauguggaau

SEQ ID NO: 1986 - RNA, 19 nt, Artificial Sequence
  siRNA antisense sequence
auuccacaugaucaagaug

SEQ ID NO: 1987 - RNA, 19 nt, Artificial Sequence
  siRNA sense sequence
aucuugaucauguggaauu

SEQ ID NO: 1988 - RNA, 19 nt, Artificial Sequence
  siRNA antisense sequence
aauuccacaugaucaagau

SEQ ID NO: 1989 - RNA, 19 nt, Artificial Sequence
  siRNA sense sequence
ucuugaucauguggaauuc

SEQ ID NO: 1990 - RNA, 19 nt, Artificial Sequence
  siRNA antisense sequence
gaauuccacaugaucaaga

SEQ ID NO: 1991 - RNA, 19 nt, Artificial Sequence
  siRNA sense sequence
cuugaucauguggaauuca

SEQ ID NO: 1992 - RNA, 19 nt, Artificial Sequence
  siRNA antisense sequence
ugaauuccacaugaucaag

SEQ ID NO: 1993 - RNA, 19 nt, Artificial Sequence
  siRNA sense sequence
ugaucauguggaauucaag

SEQ ID NO: 1994 - RNA, 19 nt, Artificial Sequence
  siRNA antisense sequence
cuugaauuccacaugauca

SEQ ID NO: 1995 - RNA, 19 nt, Artificial Sequence
  siRNA sense sequence
gaucauguggaauucaagc

SEQ ID NO: 1996 - RNA, 19 nt, Artificial Sequence
  siRNA antisense sequence
gcuugaauuccacaugauc

SEQ ID NO: 1997 - RNA, 19 nt, Artificial Sequence
  siRNA sense sequence
aucauguggaauucaagcg

SEQ ID NO: 1998 - RNA, 19 nt, Artificial Sequence
  siRNA antisense sequence
cgcuugaauuccacaugau

SEQ ID NO: 1999 - RNA, 19 nt, Artificial Sequence
  siRNA sense sequence
ucauguggaauucaagcgc

SEQ ID NO: 2000 - RNA, 19 nt, Artificial Sequence
  siRNA antisense sequence
gcgcuugaauuccacauga

SEQ ID NO: 2001 - RNA, 19 nt, Artificial Sequence
  siRNA sense sequence
cauguggaauucaagcgcu

SEQ ID NO: 2002 - RNA, 19 nt, Artificial Sequence
  siRNA antisense sequence
agcgcuugaauuccacaug

SEQ ID NO: 2003 - RNA, 19 nt, Artificial Sequence
  siRNA sense sequence
auguggaauucaagcgcuu

SEQ ID NO: 2004 - RNA, 19 nt, Artificial Sequence
  siRNA antisense sequence
aagcgcuugaauuccacau

SEQ ID NO: 2005 - RNA, 19 nt, Artificial Sequence
  siRNA sense sequence
uguggaauucaagcgcuuu

SEQ ID NO: 2006 - RNA, 19 nt, Artificial Sequence
  siRNA antisense sequence
aaagcgcuugaauuccaca

SEQ ID NO: 2007 - RNA, 19 nt, Artificial Sequence
  siRNA sense sequence
guggaauucaagcgcuuuc

SEQ ID NO: 2008 - RNA, 19 nt, Artificial Sequence
  siRNA antisense sequence
gaaagcgcuugaauuccac

SEQ ID NO: 2009 - RNA, 19 nt, Artificial Sequence
  siRNA sense sequence
uggaauucaagcgcuuucg

SEQ ID NO: 2010 - RNA, 19 nt, Artificial Sequence
  siRNA antisense sequence
cgaaagcgcuugaauucca

SEQ ID NO: 2011 - RNA, 19 nt, Artificial Sequence
  siRNA sense sequence
ggaauucaagcgcuuucgu

SEQ ID NO: 2012 - RNA, 19 nt, Artificial Sequence
  siRNA antisense sequence
acgaaagcgcuugaauucc

SEQ ID NO: 2013 - RNA, 19 nt, Artificial Sequence
  siRNA sense sequence
gaauucaagcgcuuucguu

SEQ ID NO: 2014 - RNA, 19 nt, Artificial Sequence
  siRNA antisense sequence
aacgaaagcgcuugaauuc

SEQ ID NO: 2015 - RNA, 19 nt, Artificial Sequence
  siRNA sense sequence
aauucaagcgcuuucguuu

SEQ ID NO: 2016 - RNA, 19 nt, Artificial Sequence
  siRNA antisense sequence
aaacgaaagcgcuugaauu

SEQ ID NO: 2017 - RNA, 19 nt, Artificial Sequence
  siRNA sense sequence
auucaagcgcuuucguuuu

SEQ ID NO: 2018 - RNA, 19 nt, Artificial Sequence
  siRNA antisense sequence
aaaacgaaagcgcuugaau

SEQ ID NO: 2019 - RNA, 19 nt, Artificial Sequence
  siRNA sense sequence
uccuugcuacggaucuuaa

SEQ ID NO: 2020 - RNA, 19 nt, Artificial Sequence
  siRNA antisense sequence
uuaagauccguagcaagga

SEQ ID NO: 2021 - RNA, 19 nt, Artificial Sequence
  siRNA sense sequence
ccuugcuacggaucuuaaa

SEQ ID NO: 2022 - RNA, 19 nt, Artificial Sequence
  siRNA antisense sequence
uuuaagauccguagcaagg

SEQ ID NO: 2023 - RNA, 19 nt, Artificial Sequence
  siRNA sense sequence
cuugcuacggaucuuaaaa

SEQ ID NO: 2024 - RNA, 19 nt, Artificial Sequence
  siRNA antisense sequence
uuuuaagauccguagcaag

SEQ ID NO: 2025 - RNA, 19 nt, Artificial Sequence
  siRNA sense sequence
gcauuuugauuuucucgca

SEQ ID NO: 2026 - RNA, 19 nt, Artificial Sequence
  siRNA antisense sequence
ugcgagaaaaucaaaaugc

SEQ ID NO: 2027 - RNA, 19 nt, Artificial Sequence
  siRNA sense sequence
cauuuugauuuucucgcag

SEQ ID NO: 2028 - RNA, 19 nt, Artificial Sequence
  siRNA antisense sequence
cugcgagaaaaucaaaaug

SEQ ID NO: 2029 - RNA, 19 nt, Artificial Sequence
  siRNA sense sequence
auuuugauuuucucgcaga

SEQ ID NO: 2030 - RNA, 19 nt, Artificial Sequence
  siRNA antisense sequence
ucugcgagaaaaucaaaau

SEQ ID NO: 2031 - RNA, 19 nt, Artificial Sequence
  siRNA sense sequence
ucucgcagaauucaaugcc

SEQ ID NO: 2032 - RNA, 19 nt, Artificial Sequence
  siRNA antisense sequence
ggcauugaauucugcgaga

SEQ ID NO: 2033 - RNA, 19 nt, Artificial Sequence
  siRNA sense sequence
cucgcagaauucaaugcca

SEQ ID NO: 2034 - RNA, 19 nt, Artificial Sequence
  siRNA antisense sequence
uggcauugaauucugcgag

SEQ ID NO: 2035 - RNA, 19 nt, Artificial Sequence
  siRNA sense sequence
gaauucaaugccaaggcaa

SEQ ID NO: 2036 - RNA, 19 nt, Artificial Sequence
  siRNA antisense sequence
uugccuuggcauugaauuc

SEQ ID NO: 2037 - RNA, 19 nt, Artificial Sequence
  siRNA sense sequence
aauucaaugccaaggcaaa

SEQ ID NO: 2038 - RNA, 19 nt, Artificial Sequence
  siRNA antisense sequence
uuugccuuggcauugaauu

SEQ ID NO: 2039 - RNA, 19 nt, Artificial Sequence
  siRNA sense sequence
gauguaaauaguaauggca

SEQ ID NO: 2040 - RNA, 19 nt, Artificial Sequence
  siRNA antisense sequence
ugccauuacuauuuacauc

SEQ ID NO: 2041 - RNA, 19 nt, Artificial Sequence
  siRNA sense sequence
auaguaauggcauagaaug

SEQ ID NO: 2042 - RNA, 19 nt, Artificial Sequence
  siRNA antisense sequence
cauucuaugccauuacuau

SEQ ID NO: 2043 - RNA, 19 nt, Artificial Sequence
  siRNA sense sequence
uaguaauggcauagaaugg

SEQ ID NO: 2044 - RNA, 19 nt, Artificial Sequence
  siRNA antisense sequence
ccauucuaugccauuacua

SEQ ID NO: 2045 - RNA, 19 nt, Artificial Sequence
  siRNA sense sequence
uggcauagaauggaguaau

SEQ ID NO: 2046 - RNA, 19 nt, Artificial Sequence
  siRNA antisense sequence
auuacuccauucuaugcca

SEQ ID NO: 2047 - RNA, 19 nt, Artificial Sequence
  siRNA sense sequence
ggcauagaauggaguaaug

SEQ ID NO: 2048 - RNA, 19 nt, Artificial Sequence
  siRNA antisense sequence
cauuacuccauucuaugcc

SEQ ID NO: 2049 - RNA, 19 nt, Artificial Sequence
  siRNA sense sequence
gcauagaauggaguaauga

SEQ ID NO: 2050 - RNA, 19 nt, Artificial Sequence
  siRNA antisense sequence
ucauuacuccauucuaugc

SEQ ID NO: 2051 - RNA, 19 nt, Artificial Sequence
  siRNA sense sequence
cauagaauggaguaaugaa

SEQ ID NO: 2052 - RNA, 19 nt, Artificial Sequence
  siRNA antisense sequence
uucauuacuccauucuaug

SEQ ID NO: 2053 - RNA, 19 nt, Artificial Sequence
  siRNA sense sequence
aaaugaucgccucuuggua

SEQ ID NO: 2054 - RNA, 19 nt, Artificial Sequence
  siRNA antisense sequence
uaccaagaggcgaucauuu

SEQ ID NO: 2055 - RNA, 19 nt, Artificial Sequence
  siRNA sense sequence
aaugaucgccucuugguau

SEQ ID NO: 2056 - RNA, 19 nt, Artificial Sequence
  siRNA antisense sequence
auaccaagaggcgaucauu

SEQ ID NO: 2057 - RNA, 19 nt, Artificial Sequence
  siRNA sense sequence
augaucgccucuugguaug

SEQ ID NO: 2058 - RNA, 19 nt, Artificial Sequence
  siRNA antisense sequence
cauaccaagaggcgaucau

SEQ ID NO: 2059 - RNA, 19 nt, Artificial Sequence
  siRNA sense sequence
ugaucgccucuugguaugc

SEQ ID NO: 2060 - RNA, 19 nt, Artificial Sequence
  siRNA antisense sequence
gcauaccaagaggcgauca

SEQ ID NO: 2061 - RNA, 19 nt, Artificial Sequence
  siRNA sense sequence
gaucgccucuugguaugcc

SEQ ID NO: 2062 - RNA, 19 nt, Artificial Sequence
  siRNA antisense sequence
ggcauaccaagaggcgauc

SEQ ID NO: 2063 - RNA, 19 nt, Artificial Sequence
  siRNA sense sequence
aucgccucuugguaugcca

SEQ ID NO: 2064 - RNA, 19 nt, Artificial Sequence
  siRNA antisense sequence
uggcauaccaagaggcgau

SEQ ID NO: 2065 - RNA, 19 nt, Artificial Sequence
  siRNA sense sequence
ucgccucuugguaugccag

SEQ ID NO: 2066 - RNA, 19 nt, Artificial Sequence
  siRNA antisense sequence
cuggcauaccaagaggcga

SEQ ID NO: 2067 - RNA, 19 nt, Artificial Sequence
  siRNA sense sequence
cucuugguaugccaggugu

SEQ ID NO: 2068 - RNA, 19 nt, Artificial Sequence
  siRNA antisense sequence
acaccuggcauaccaagag

SEQ ID NO: 2069 - RNA, 19 nt, Artificial Sequence
  siRNA sense sequence
ucuugguaugccaggugug

SEQ ID NO: 2070 - RNA, 19 nt, Artificial Sequence
  siRNA antisense sequence
cacaccuggcauaccaaga

SEQ ID NO: 2071 - RNA, 19 nt, Artificial Sequence
  siRNA sense sequence
cuugguaugccaggugugc

SEQ ID NO: 2072 - RNA, 19 nt, Artificial Sequence
  siRNA antisense sequence
gcacaccuggcauaccaag

SEQ ID NO: 2073 - RNA, 19 nt, Artificial Sequence
  siRNA sense sequence
uugguaugccaggugugca

SEQ ID NO: 2074 - RNA, 19 nt, Artificial Sequence
  siRNA antisense sequence
ugcacaccuggcauaccaa

SEQ ID NO: 2075 - RNA, 19 nt, Artificial Sequence
  siRNA sense sequence
aacuggcagauauaaaugg

SEQ ID NO: 2076 - RNA, 19 nt, Artificial Sequence
  siRNA antisense sequence
ccauuuauaucugccaguu

SEQ ID NO: 2077 - RNA, 19 nt, Artificial Sequence
  siRNA sense sequence
acuggcagauauaaauggc

SEQ ID NO: 2078 - RNA, 19 nt, Artificial Sequence
  siRNA antisense sequence
gccauuuauaucugccagu

SEQ ID NO: 2079 - RNA, 19 nt, Artificial Sequence
  siRNA sense sequence
cuggcagauauaaauggcc

SEQ ID NO: 2080 - RNA, 19 nt, Artificial Sequence
  siRNA antisense sequence
ggccauuuauaucugccag

SEQ ID NO: 2081 - RNA, 19 nt, Artificial Sequence
  siRNA sense sequence
uggcagauauaaauggccc

SEQ ID NO: 2082 - RNA, 19 nt, Artificial Sequence
  siRNA antisense sequence
gggccauuuauaucugcca

SEQ ID NO: 2083 - RNA, 19 nt, Artificial Sequence
  siRNA sense sequence
ggcagauauaaauggccca

SEQ ID NO: 2084 - RNA, 19 nt, Artificial Sequence
  siRNA antisense sequence
ugggccauuuauaucugcc

SEQ ID NO: 2085 - RNA, 19 nt, Artificial Sequence
  siRNA sense sequence
cagauauaaauggcccagc

SEQ ID NO: 2086 - RNA, 19 nt, Artificial Sequence
  siRNA antisense sequence
gcugggccauuuauaucug

SEQ ID NO: 2087 - RNA, 19 nt, Artificial Sequence
  siRNA sense sequence
agauauaaauggcccagca

SEQ ID NO: 2088 - RNA, 19 nt, Artificial Sequence
  siRNA antisense sequence
ugcugggccauuuauaucu

SEQ ID NO: 2089 - RNA, 19 nt, Artificial Sequence
  siRNA sense sequence
gauauaaauggcccagcaa

SEQ ID NO: 2090 - RNA, 19 nt, Artificial Sequence
  siRNA antisense sequence
uugcugggccauuuauauc

SEQ ID NO: 2091 - RNA, 19 nt, Artificial Sequence
  siRNA sense sequence
auauaaauggcccagcaaa

SEQ ID NO: 2092 - RNA, 19 nt, Artificial Sequence
  siRNA antisense sequence
uuugcugggccauuuauau

SEQ ID NO: 2093 - RNA, 19 nt, Artificial Sequence
  siRNA sense sequence
uauaaauggcccagcaaaa

SEQ ID NO: 2094 - RNA, 19 nt, Artificial Sequence
  siRNA antisense sequence
uuuugcugggccauuuaua

SEQ ID NO: 2095 - RNA, 19 nt, Artificial Sequence
  siRNA sense sequence
auaaauggcccagcaaaag

SEQ ID NO: 2096 - RNA, 19 nt, Artificial Sequence
  siRNA antisense sequence
cuuuugcugggccauuuau

SEQ ID NO: 2097 - RNA, 19 nt, Artificial Sequence
  siRNA sense sequence
aaauggcccagcaaaaguu

SEQ ID NO: 2098 - RNA, 19 nt, Artificial Sequence
  siRNA antisense sequence
aacuuuugcugggccauuu

SEQ ID NO: 2099 - RNA, 19 nt, Artificial Sequence
  siRNA sense sequence
aauggcccagcaaaaguuc

SEQ ID NO: 2100 - RNA, 19 nt, Artificial Sequence
  siRNA antisense sequence
gaacuuuugcugggccauu

SEQ ID NO: 2101 - RNA, 19 nt, Artificial Sequence
  siRNA sense sequence
auggcccagcaaaaguucg

SEQ ID NO: 2102 - RNA, 19 nt, Artificial Sequence
  siRNA antisense sequence
cgaacuuuugcugggccau

SEQ ID NO: 2103 - RNA, 19 nt, Artificial Sequence
  siRNA sense sequence
uggcccagcaaaaguucga

SEQ ID NO: 2104 - RNA, 19 nt, Artificial Sequence
  siRNA antisense sequence
ucgaacuuuugcugggcca

SEQ ID NO: 2105 - RNA, 19 nt, Artificial Sequence
  siRNA sense sequence
ggcccagcaaaaguucgag

SEQ ID NO: 2106 - RNA, 19 nt, Artificial Sequence
  siRNA antisense sequence
cucgaacuuuugcugggcc

SEQ ID NO: 2107 - RNA, 19 nt, Artificial Sequence
  siRNA sense sequence
agaagcaaaucuuggucug

SEQ ID NO: 2108 - RNA, 19 nt, Artificial Sequence
  siRNA antisense sequence
cagaccaagauuugcuucu

SEQ ID NO: 2109 - RNA, 19 nt, Artificial Sequence
  siRNA sense sequence
gaagcaaaucuuggucugc

SEQ ID NO: 2110 - RNA, 19 nt, Artificial Sequence
  siRNA antisense sequence
gcagaccaagauuugcuuc

SEQ ID NO: 2111 - RNA, 19 nt, Artificial Sequence
  siRNA sense sequence
aagcaaaucuuggucugcc

SEQ ID NO: 2112 - RNA, 19 nt, Artificial Sequence
  siRNA antisense sequence
ggcagaccaagauuugcuu

SEQ ID NO: 2113 - RNA, 19 nt, Artificial Sequence
  siRNA sense sequence
agcaaaucuuggucugccc

SEQ ID NO: 2114 - RNA, 19 nt, Artificial Sequence
  siRNA antisense sequence
gggcagaccaagauuugcu

SEQ ID NO: 2115 - RNA, 19 nt, Artificial Sequence
  siRNA sense sequence
gcaaaucuuggucugccca

SEQ ID NO: 2116 - RNA, 19 nt, Artificial Sequence
  siRNA antisense sequence
ugggcagaccaagauuugc

SEQ ID NO: 2117 - RNA, 19 nt, Artificial Sequence
  siRNA sense sequence
caaaucuuggucugcccau

SEQ ID NO: 2118 - RNA, 19 nt, Artificial Sequence
  siRNA antisense sequence
augggcagaccaagauuug

SEQ ID NO: 2119 - RNA, 19 nt, Artificial Sequence
  siRNA sense sequence
aaaucuuggucugcccauc

SEQ ID NO: 2120 - RNA, 19 nt, Artificial Sequence
  siRNA antisense sequence
gaugggcagaccaagauuu

SEQ ID NO: 2121 - RNA, 19 nt, Artificial Sequence
  siRNA sense sequence
uuggucugcccaucagucc

SEQ ID NO: 2122 - RNA, 19 nt, Artificial Sequence
  siRNA antisense sequence
ggacugaugggcagaccaa

SEQ ID NO: 2123 - RNA, 19 nt, Artificial Sequence
  siRNA sense sequence
uggucugcccaucagucca

SEQ ID NO: 2124 - RNA, 19 nt, Artificial Sequence
  siRNA antisense sequence
uggacugaugggcagacca

SEQ ID NO: 2125 - RNA, 19 nt, Artificial Sequence
  siRNA sense sequence
ggucugcccaucaguccau

SEQ ID NO: 2126 - RNA, 19 nt, Artificial Sequence
  siRNA antisense sequence
auggacugaugggcagacc

SEQ ID NO: 2127 - RNA, 19 nt, Artificial Sequence
  siRNA sense sequence
gucugcccaucaguccauu

SEQ ID NO: 2128 - RNA, 19 nt, Artificial Sequence
  siRNA antisense sequence
aauggacugaugggcagac

SEQ ID NO: 2129 - RNA, 19 nt, Artificial Sequence
  siRNA sense sequence
ucugcccaucaguccauuc

SEQ ID NO: 2130 - RNA, 19 nt, Artificial Sequence
  siRNA antisense sequence
gaauggacugaugggcaga

SEQ ID NO: 2131 - RNA, 19 nt, Artificial Sequence
  siRNA sense sequence
cugcccaucaguccauuca

SEQ ID NO: 2132 - RNA, 19 nt, Artificial Sequence
  siRNA antisense sequence
ugaauggacugaugggcag

SEQ ID NO: 2133 - RNA, 19 nt, Artificial Sequence
  siRNA sense sequence
ugcccaucaguccauucau

SEQ ID NO: 2134 - RNA, 19 nt, Artificial Sequence
  siRNA antisense sequence
augaauggacugaugggca

SEQ ID NO: 2135 - RNA, 19 nt, Artificial Sequence
  siRNA sense sequence
gcccaucaguccauucaug

SEQ ID NO: 2136 - RNA, 19 nt, Artificial Sequence
  siRNA antisense sequence
caugaauggacugaugggc

SEQ ID NO: 2137 - RNA, 19 nt, Artificial Sequence
  siRNA sense sequence
ccauucauggaucguucuu

SEQ ID NO: 2138 - RNA, 19 nt, Artificial Sequence
  siRNA antisense sequence
aagaacgauccaugaaugg

SEQ ID NO: 2139 - RNA, 19 nt, Artificial Sequence
  siRNA sense sequence
cauucauggaucguucuuc

SEQ ID NO: 2140 - RNA, 19 nt, Artificial Sequence
  siRNA antisense sequence
gaagaacgauccaugaaug

SEQ ID NO: 2141 - RNA, 19 nt, Artificial Sequence
  siRNA sense sequence
auucauggaucguucuucu

SEQ ID NO: 2142 - RNA, 19 nt, Artificial Sequence
  siRNA antisense sequence
agaagaacgauccaugaau

SEQ ID NO: 2143 - RNA, 19 nt, Artificial Sequence
  siRNA sense sequence
uucauggaucguucuucuc

SEQ ID NO: 2144 - RNA, 19 nt, Artificial Sequence
  siRNA antisense sequence
gagaagaacgauccaugaa

SEQ ID NO: 2145 - RNA, 19 nt, Artificial Sequence
  siRNA sense sequence
ucauggaucguucuucucc

SEQ ID NO: 2146 - RNA, 19 nt, Artificial Sequence
  siRNA antisense sequence
ggagaagaacgauccauga

SEQ ID NO: 2147 - RNA, 19 nt, Artificial Sequence
  siRNA sense sequence
cauggaucguucuucuccu

SEQ ID NO: 2148 - RNA, 19 nt, Artificial Sequence
  siRNA antisense sequence
aggagaagaacgauccaug

SEQ ID NO: 2149 - RNA, 19 nt, Artificial Sequence
  siRNA sense sequence
auggaucguucuucuccuc

SEQ ID NO: 2150 - RNA, 19 nt, Artificial Sequence
  siRNA antisense sequence
gaggagaagaacgauccau

SEQ ID NO: 2151 - RNA, 19 nt, Artificial Sequence
  siRNA sense sequence
aucguucuucuccucaacu

SEQ ID NO: 2152 - RNA, 19 nt, Artificial Sequence
  siRNA antisense sequence
aguugaggagaagaacgau

SEQ ID NO: 2153 - RNA, 19 nt, Artificial Sequence
  siRNA sense sequence
ucguucuucuccucaacua

SEQ ID NO: 2154 - RNA, 19 nt, Artificial Sequence
  siRNA antisense sequence
uaguugaggagaagaacga

SEQ ID NO: 2155 - RNA, 19 nt, Artificial Sequence
  siRNA sense sequence
cguucuucuccucaacuag

SEQ ID NO: 2156 - RNA, 19 nt, Artificial Sequence
  siRNA antisense sequence
cuaguugaggagaagaacg

SEQ ID NO: 2157 - RNA, 19 nt, Artificial Sequence
  siRNA sense sequence
guucuucuccucaacuagc

SEQ ID NO: 2158 - RNA, 19 nt, Artificial Sequence
  siRNA antisense sequence
gcuaguugaggagaagaac

SEQ ID NO: 2159 - RNA, 19 nt, Artificial Sequence
  siRNA sense sequence
uucuucuccucaacuagca

SEQ ID NO: 2160 - RNA, 19 nt, Artificial Sequence
  siRNA antisense sequence
ugcuaguugaggagaagaa

SEQ ID NO: 2161 - RNA, 19 nt, Artificial Sequence
  siRNA sense sequence
ucuucuccucaacuagcaa

SEQ ID NO: 2162 - RNA, 19 nt, Artificial Sequence
  siRNA antisense sequence
uugcuaguugaggagaaga

SEQ ID NO: 2163 - RNA, 19 nt, Artificial Sequence
  siRNA sense sequence
cuucuccucaacuagcaaa

SEQ ID NO: 2164 - RNA, 19 nt, Artificial Sequence
  siRNA antisense sequence
uuugcuaguugaggagaag

SEQ ID NO: 2165 - RNA, 19 nt, Artificial Sequence
  siRNA sense sequence
uucuccucaacuagcaaaa

SEQ ID NO: 2166 - RNA, 19 nt, Artificial Sequence
  siRNA antisense sequence
uuuugcuaguugaggagaa

SEQ ID NO: 2167 - RNA, 19 nt, Artificial Sequence
  siRNA sense sequence
acuccaagaaucuuuuauc

SEQ ID NO: 2168 - RNA, 19 nt, Artificial Sequence
  siRNA antisense sequence
gauaaaagauucuuggagu

SEQ ID NO: 2169 - RNA, 19 nt, Artificial Sequence
  siRNA sense sequence
cuccaagaaucuuuuauca

SEQ ID NO: 2170 - RNA, 19 nt, Artificial Sequence
  siRNA antisense sequence
ugauaaaagauucuuggag

SEQ ID NO: 2171 - RNA, 19 nt, Artificial Sequence
  siRNA sense sequence
uccaagaaucuuuuaucac

SEQ ID NO: 2172 - RNA, 19 nt, Artificial Sequence
  siRNA antisense sequence
gugauaaaagauucuugga

SEQ ID NO: 2173 - RNA, 19 nt, Artificial Sequence
  siRNA sense sequence
ccaagaaucuuuuaucacc

SEQ ID NO: 2174 - RNA, 19 nt, Artificial Sequence
  siRNA antisense sequence
ggugauaaaagauucuugg

SEQ ID NO: 2175 - RNA, 19 nt, Artificial Sequence
  siRNA sense sequence
caagaaucuuuuaucaccc

SEQ ID NO: 2176 - RNA, 19 nt, Artificial Sequence
  siRNA antisense sequence
gggugauaaaagauucuug

SEQ ID NO: 2177 - RNA, 19 nt, Artificial Sequence
  siRNA sense sequence
aagaaucuuuuaucaccca

SEQ ID NO: 2178 - RNA, 19 nt, Artificial Sequence
  siRNA antisense sequence
ugggugauaaaagauucuu

SEQ ID NO: 2179 - RNA, 19 nt, Artificial Sequence
  siRNA sense sequence
cuuuuaucacccacauagu

SEQ ID NO: 2180 - RNA, 19 nt, Artificial Sequence
  siRNA antisense sequence
acuaugugggugauaaaag

SEQ ID NO: 2181 - RNA, 19 nt, Artificial Sequence
  siRNA sense sequence
uuuuaucacccacauagug

SEQ ID NO: 2182 - RNA, 19 nt, Artificial Sequence
  siRNA antisense sequence
cacuaugugggugauaaaa

SEQ ID NO: 2183 - RNA, 19 nt, Artificial Sequence
  siRNA sense sequence
guguaacuccuaugaugcu

SEQ ID NO: 2184 - RNA, 19 nt, Artificial Sequence
  siRNA antisense sequence
agcaucauaggaguuacac

SEQ ID NO: 2185 - RNA, 19 nt, Artificial Sequence
  siRNA sense sequence
uguaacuccuaugaugcug

SEQ ID NO: 2186 - RNA, 19 nt, Artificial Sequence
  siRNA antisense sequence
cagcaucauaggaguuaca

SEQ ID NO: 2187 - RNA, 19 nt, Artificial Sequence
  siRNA sense sequence
ccuaugaugcugcugguuu

SEQ ID NO: 2188 - RNA, 19 nt, Artificial Sequence
  siRNA antisense sequence
aaaccagcagcaucauagg

SEQ ID NO: 2189 - RNA, 19 nt, Artificial Sequence
  siRNA sense sequence
ugaugcugcugguuugcua

SEQ ID NO: 2190 - RNA, 19 nt, Artificial Sequence
  siRNA antisense sequence
uagcaaaccagcagcauca

SEQ ID NO: 2191 - RNA, 19 nt, Artificial Sequence
  siRNA sense sequence
gaugcugcugguuugcuac

SEQ ID NO: 2192 - RNA, 19 nt, Artificial Sequence
  siRNA antisense sequence
guagcaaaccagcagcauc

SEQ ID NO: 2193 - RNA, 19 nt, Artificial Sequence
  siRNA sense sequence
augcugcugguuugcuacc

SEQ ID NO: 2194 - RNA, 19 nt, Artificial Sequence
  siRNA antisense sequence
gguagcaaaccagcagcau

SEQ ID NO: 2195 - RNA, 19 nt, Artificial Sequence
  siRNA sense sequence
guuugcuaccaggucagug

SEQ ID NO: 2196 - RNA, 19 nt, Artificial Sequence
  siRNA antisense sequence
cacugaccugguagcaaac

SEQ ID NO: 2197 - RNA, 19 nt, Artificial Sequence
  siRNA sense sequence
uuugcuaccaggucagugg

SEQ ID NO: 2198 - RNA, 19 nt, Artificial Sequence
  siRNA antisense sequence
ccacugaccugguagcaaa

SEQ ID NO: 2199 - RNA, 19 nt, Artificial Sequence
  siRNA sense sequence
aagcagaagaggauaauga

SEQ ID NO: 2200 - RNA, 19 nt, Artificial Sequence
  siRNA antisense sequence
ucauuauccucuucugcuu

SEQ ID NO: 2201 - RNA, 19 nt, Artificial Sequence
  siRNA sense sequence
cagaagaggauaaugauac

SEQ ID NO: 2202 - RNA, 19 nt, Artificial Sequence
  siRNA antisense sequence
guaucauuauccucuucug

SEQ ID NO: 2203 - RNA, 19 nt, Artificial Sequence
  siRNA sense sequence
agaagaggauaaugauacu

SEQ ID NO: 2204 - RNA, 19 nt, Artificial Sequence
  siRNA antisense sequence
aguaucauuauccucuucu

SEQ ID NO: 2205 - RNA, 19 nt, Artificial Sequence
  siRNA sense sequence
gaagaggauaaugauacug

SEQ ID NO: 2206 - RNA, 19 nt, Artificial Sequence
  siRNA antisense sequence
caguaucauuauccucuuc

SEQ ID NO: 2207 - RNA, 19 nt, Artificial Sequence
  siRNA sense sequence
aagaggauaaugauacuga

SEQ ID NO: 2208 - RNA, 19 nt, Artificial Sequence
  siRNA antisense sequence
ucaguaucauuauccucuu

SEQ ID NO: 2209 - RNA, 19 nt, Artificial Sequence
  siRNA sense sequence
aaguggugaugaugaagac

SEQ ID NO: 2210 - RNA, 19 nt, Artificial Sequence
  siRNA antisense sequence
gucuucaucaucaccacuu

SEQ ID NO: 2211 - RNA, 19 nt, Artificial Sequence
  siRNA sense sequence
ugaugaagacggugaagaa

SEQ ID NO: 2212 - RNA, 19 nt, Artificial Sequence
  siRNA antisense sequence
uucuucaccgucuucauca

SEQ ID NO: 2213 - RNA, 19 nt, Artificial Sequence
  siRNA sense sequence
gaugaagacggugaagaau

SEQ ID NO: 2214 - RNA, 19 nt, Artificial Sequence
  siRNA antisense sequence
auucuucaccgucuucauc

SEQ ID NO: 2215 - RNA, 19 nt, Artificial Sequence
  siRNA sense sequence
augaagacggugaagaauu

SEQ ID NO: 2216 - RNA, 19 nt, Artificial Sequence
  siRNA antisense sequence
aauucuucaccgucuucau

SEQ ID NO: 2217 - RNA, 19 nt, Artificial Sequence
  siRNA sense sequence
ugaagacggugaagaauua

SEQ ID NO: 2218 - RNA, 19 nt, Artificial Sequence
  siRNA antisense sequence
uaauucuucaccgucuuca

SEQ ID NO: 2219 - RNA, 19 nt, Artificial Sequence
  siRNA sense sequence
gaagacggugaagaauuag

SEQ ID NO: 2220 - RNA, 19 nt, Artificial Sequence
  siRNA antisense sequence
cuaauucuucaccgucuuc

SEQ ID NO: 2221 - RNA, 19 nt, Artificial Sequence
  siRNA sense sequence
aagacggugaagaauuaga

SEQ ID NO: 2222 - RNA, 19 nt, Artificial Sequence
  siRNA antisense sequence
ucuaauucuucaccgucuu

SEQ ID NO: 2223 - RNA, 19 nt, Artificial Sequence
  siRNA sense sequence
agacggugaagaauuagau

SEQ ID NO: 2224 - RNA, 19 nt, Artificial Sequence
  siRNA antisense sequence
aucuaauucuucaccgucu

SEQ ID NO: 2225 - RNA, 19 nt, Artificial Sequence
  siRNA sense sequence
gacggugaagaauuagaua

SEQ ID NO: 2226 - RNA, 19 nt, Artificial Sequence
  siRNA antisense sequence
uaucuaauucuucaccguc

SEQ ID NO: 2227 - RNA, 19 nt, Artificial Sequence
  siRNA sense sequence
acggugaagaauuagauac

SEQ ID NO: 2228 - RNA, 19 nt, Artificial Sequence
  siRNA antisense sequence
guaucuaauucuucaccgu

SEQ ID NO: 2229 - RNA, 19 nt, Artificial Sequence
  siRNA sense sequence
cggugaagaauuagauaca

SEQ ID NO: 2230 - RNA, 19 nt, Artificial Sequence
  siRNA antisense sequence
uguaucuaauucuucaccg

SEQ ID NO: 2231 - RNA, 19 nt, Artificial Sequence
  siRNA sense sequence
ggugaagaauuagauacag

SEQ ID NO: 2232 - RNA, 19 nt, Artificial Sequence
  siRNA antisense sequence
cuguaucuaauucuucacc

SEQ ID NO: 2233 - RNA, 19 nt, Artificial Sequence
  siRNA sense sequence
gaauuagauacagaagaug

SEQ ID NO: 2234 - RNA, 19 nt, Artificial Sequence
  siRNA antisense sequence
caucuucuguaucuaauuc

SEQ ID NO: 2235 - RNA, 19 nt, Artificial Sequence
  siRNA sense sequence
uuagauacagaagaugaag

SEQ ID NO: 2236 - RNA, 19 nt, Artificial Sequence
  siRNA antisense sequence
cuucaucuucuguaucuaa

SEQ ID NO: 2237 - RNA, 19 nt, Artificial Sequence
  siRNA sense sequence
uagauacagaagaugaaga

SEQ ID NO: 2238 - RNA, 19 nt, Artificial Sequence
  siRNA antisense sequence
ucuucaucuucuguaucua

SEQ ID NO: 2239 - RNA, 19 nt, Artificial Sequence
  siRNA sense sequence
aaaagcagacggcgaauau

SEQ ID NO: 2240 - RNA, 19 nt, Artificial Sequence
  siRNA antisense sequence
auauucgccgucugcuuuu

SEQ ID NO: 2241 - RNA, 19 nt, Artificial Sequence
  siRNA sense sequence
aaagcagacggcgaauauu

SEQ ID NO: 2242 - RNA, 19 nt, Artificial Sequence
  siRNA antisense sequence
aauauucgccgucugcuuu

SEQ ID NO: 2243 - RNA, 19 nt, Artificial Sequence
  siRNA sense sequence
aagcagacggcgaauauuu

SEQ ID NO: 2244 - RNA, 19 nt, Artificial Sequence
  siRNA antisense sequence
aaauauucgccgucugcuu

SEQ ID NO: 2245 - RNA, 19 nt, Artificial Sequence
  siRNA sense sequence
agcagacggcgaauauuuu

SEQ ID NO: 2246 - RNA, 19 nt, Artificial Sequence
  siRNA antisense sequence
aaaauauucgccgucugcu

SEQ ID NO: 2247 - RNA, 19 nt, Artificial Sequence
  siRNA sense sequence
gcagacggcgaauauuuug

SEQ ID NO: 2248 - RNA, 19 nt, Artificial Sequence
  siRNA antisense sequence
caaaauauucgccgucugc

SEQ ID NO: 2249 - RNA, 19 nt, Artificial Sequence
  siRNA sense sequence
cagacggcgaauauuuugu

SEQ ID NO: 2250 - RNA, 19 nt, Artificial Sequence
  siRNA antisense sequence
acaaaauauucgccgucug

SEQ ID NO: 2251 - RNA, 19 nt, Artificial Sequence
  siRNA sense sequence
agacggcgaauauuuuguc

SEQ ID NO: 2252 - RNA, 19 nt, Artificial Sequence
  siRNA antisense sequence
gacaaaauauucgccgucu

SEQ ID NO: 2253 - RNA, 19 nt, Artificial Sequence
  siRNA sense sequence
gacggcgaauauuuuguca

SEQ ID NO: 2254 - RNA, 19 nt, Artificial Sequence
  siRNA antisense sequence
ugacaaaauauucgccguc

SEQ ID NO: 2255 - RNA, 19 nt, Artificial Sequence
  siRNA sense sequence
acggcgaauauuuugucag

SEQ ID NO: 2256 - RNA, 19 nt, Artificial Sequence
  siRNA antisense sequence
cugacaaaauauucgccgu

SEQ ID NO: 2257 - RNA, 19 nt, Artificial Sequence
  siRNA sense sequence
cggcgaauauuuugucagc

SEQ ID NO: 2258 - RNA, 19 nt, Artificial Sequence
  siRNA antisense sequence
gcugacaaaauauucgccg

SEQ ID NO: 2259 - RNA, 19 nt, Artificial Sequence
  siRNA sense sequence
gcgaauauuuugucagcua

SEQ ID NO: 2260 - RNA, 19 nt, Artificial Sequence
  siRNA antisense sequence
uagcugacaaaauauucgc

SEQ ID NO: 2261 - RNA, 19 nt, Artificial Sequence
  siRNA sense sequence
cgaauauuuugucagcuaa

SEQ ID NO: 2262 - RNA, 19 nt, Artificial Sequence
  siRNA antisense sequence
uuagcugacaaaauauucg

SEQ ID NO: 2263 - RNA, 19 nt, Artificial Sequence
  siRNA sense sequence
auauuuugucagcuaaugc

SEQ ID NO: 2264 - RNA, 19 nt, Artificial Sequence
  siRNA antisense sequence
gcauuagcugacaaaauau

SEQ ID NO: 2265 - RNA, 19 nt, Artificial Sequence
  siRNA sense sequence
uuugucagcuaaugcacca

SEQ ID NO: 2266 - RNA, 19 nt, Artificial Sequence
  siRNA antisense sequence
uggugcauuagcugacaaa

SEQ ID NO: 2267 - RNA, 19 nt, Artificial Sequence
  siRNA sense sequence
uugucagcuaaugcaccac

SEQ ID NO: 2268 - RNA, 19 nt, Artificial Sequence
  siRNA antisense sequence
guggugcauuagcugacaa

SEQ ID NO: 2269 - RNA, 19 nt, Artificial Sequence
  siRNA sense sequence
cagcuaaugcaccaccuca

SEQ ID NO: 2270 - RNA, 19 nt, Artificial Sequence
  siRNA antisense sequence
ugagguggugcauuagcug

SEQ ID NO: 2271 - RNA, 19 nt, Artificial Sequence
  siRNA sense sequence
agcuaaugcaccaccucac

SEQ ID NO: 2272 - RNA, 19 nt, Artificial Sequence
  siRNA antisense sequence
gugagguggugcauuagcu

SEQ ID NO: 2273 - RNA, 19 nt, Artificial Sequence
  siRNA sense sequence
gcuaaugcaccaccucacu

SEQ ID NO: 2274 - RNA, 19 nt, Artificial Sequence
  siRNA antisense sequence
agugagguggugcauuagc

SEQ ID NO: 2275 - RNA, 19 nt, Artificial Sequence
  siRNA sense sequence
cuaaugcaccaccucacug

SEQ ID NO: 2276 - RNA, 19 nt, Artificial Sequence
  siRNA antisense sequence
cagugagguggugcauuag

SEQ ID NO: 2277 - RNA, 19 nt, Artificial Sequence
  siRNA sense sequence
uaaugcaccaccucacuga

SEQ ID NO: 2278 - RNA, 19 nt, Artificial Sequence
  siRNA antisense sequence
ucagugagguggugcauua

SEQ ID NO: 2279 - RNA, 19 nt, Artificial Sequence
  siRNA sense sequence
aaugcaccaccucacugaa

SEQ ID NO: 2280 - RNA, 19 nt, Artificial Sequence
  siRNA antisense sequence
uucagugagguggugcauu

SEQ ID NO: 2281 - RNA, 19 nt, Artificial Sequence
  siRNA sense sequence
aaaucguagaggaagaaga

SEQ ID NO: 2282 - RNA, 19 nt, Artificial Sequence
  siRNA antisense sequence
ucuucuuccucuacgauuu

SEQ ID NO: 2283 - RNA, 19 nt, Artificial Sequence
  siRNA sense sequence
aaucguagaggaagaagaa

SEQ ID NO: 2284 - RNA, 19 nt, Artificial Sequence
  siRNA antisense sequence
uucuucuuccucuacgauu

SEQ ID NO: 2285 - RNA, 19 nt, Artificial Sequence
  siRNA sense sequence
aaaauguaaagcugauggg

SEQ ID NO: 2286 - RNA, 19 nt, Artificial Sequence
  siRNA antisense sequence
cccaucagcuuuacauuuu

SEQ ID NO: 2287 - RNA, 19 nt, Artificial Sequence
  siRNA sense sequence
aaauguaaagcugauggga

SEQ ID NO: 2288 - RNA, 19 nt, Artificial Sequence
  siRNA antisense sequence
ucccaucagcuuuacauuu

SEQ ID NO: 2289 - RNA, 19 nt, Artificial Sequence
  siRNA sense sequence
aauguaaagcugaugggaa

SEQ ID NO: 2290 - RNA, 19 nt, Artificial Sequence
  siRNA antisense sequence
uucccaucagcuuuacauu

SEQ ID NO: 2291 - RNA, 19 nt, Artificial Sequence
  siRNA sense sequence
auguaaagcugaugggaau

SEQ ID NO: 2292 - RNA, 19 nt, Artificial Sequence
  siRNA antisense sequence
auucccaucagcuuuacau

SEQ ID NO: 2293 - RNA, 19 nt, Artificial Sequence
  siRNA sense sequence
uguaaagcugaugggaaua

SEQ ID NO: 2294 - RNA, 19 nt, Artificial Sequence
  siRNA antisense sequence
uauucccaucagcuuuaca

SEQ ID NO: 2295 - RNA, 19 nt, Artificial Sequence
  siRNA sense sequence
guaaagcugaugggaauaa

SEQ ID NO: 2296 - RNA, 19 nt, Artificial Sequence
  siRNA antisense sequence
uuauucccaucagcuuuac

SEQ ID NO: 2297 - RNA, 19 nt, Artificial Sequence
  siRNA sense sequence
uaaagcugaugggaauaaa

SEQ ID NO: 2298 - RNA, 19 nt, Artificial Sequence
  siRNA antisense sequence
uuuauucccaucagcuuua

SEQ ID NO: 2299 - RNA, 19 nt, Artificial Sequence
  siRNA sense sequence
auuccuccuuaccucaagc

SEQ ID NO: 2300 - RNA, 19 nt, Artificial Sequence
  siRNA antisense sequence
gcuugagguaaggaggaau

SEQ ID NO: 2301 - RNA, 19 nt, Artificial Sequence
  siRNA sense sequence
uccuccuuaccucaagcag

SEQ ID NO: 2302 - RNA, 19 nt, Artificial Sequence
  siRNA antisense sequence
cugcuugagguaaggagga

SEQ ID NO: 2303 - RNA, 19 nt, Artificial Sequence
  siRNA sense sequence
ccuccuuaccucaagcaga

SEQ ID NO: 2304 - RNA, 19 nt, Artificial Sequence
  siRNA antisense sequence
ucugcuugagguaaggagg

SEQ ID NO: 2305 - RNA, 19 nt, Artificial Sequence
  siRNA sense sequence
ccuuaccucaagcagauga

SEQ ID NO: 2306 - RNA, 19 nt, Artificial Sequence
  siRNA antisense sequence
ucaucugcuugagguaagg

SEQ ID NO: 2307 - RNA, 19 nt, Artificial Sequence
  siRNA sense sequence
cagguaauugaagaggcag

SEQ ID NO: 2308 - RNA, 19 nt, Artificial Sequence
  siRNA antisense sequence
cugccucuucaauuaccug

SEQ ID NO: 2309 - RNA, 19 nt, Artificial Sequence
  siRNA sense sequence
uaauugaagaggcagauga

SEQ ID NO: 2310 - RNA, 19 nt, Artificial Sequence
  siRNA antisense sequence
ucaucugccucuucaauua

SEQ ID NO: 2311 - RNA, 19 nt, Artificial Sequence
  siRNA sense sequence
aauugaagaggcagaugaa

SEQ ID NO: 2312 - RNA, 19 nt, Artificial Sequence
  siRNA antisense sequence
uucaucugccucuucaauu

SEQ ID NO: 2313 - RNA, 19 nt, Artificial Sequence
  siRNA sense sequence
auugaagaggcagaugaag

SEQ ID NO: 2314 - RNA, 19 nt, Artificial Sequence
  siRNA antisense sequence
cuucaucugccucuucaau

SEQ ID NO: 2315 - RNA, 19 nt, Artificial Sequence
  siRNA sense sequence
uugaagaggcagaugaaga

SEQ ID NO: 2316 - RNA, 19 nt, Artificial Sequence
  siRNA antisense sequence
ucuucaucugccucuucaa

SEQ ID NO: 2317 - RNA, 19 nt, Artificial Sequence
  siRNA sense sequence
ugaagaggcagaugaagag

SEQ ID NO: 2318 - RNA, 19 nt, Artificial Sequence
  siRNA antisense sequence
cucuucaucugccucuuca

SEQ ID NO: 2319 - RNA, 19 nt, Artificial Sequence
  siRNA sense sequence
gaagaggcagaugaagagg

SEQ ID NO: 2320 - RNA, 19 nt, Artificial Sequence
  siRNA antisense sequence
ccucuucaucugccucuuc

SEQ ID NO: 2321 - RNA, 19 nt, Artificial Sequence
  siRNA sense sequence
agaugaagaggaauagcga

SEQ ID NO: 2322 - RNA, 19 nt, Artificial Sequence
  siRNA antisense sequence
ucgcuauuccucuucaucu

SEQ ID NO: 2323 - RNA, 19 nt, Artificial Sequence
  siRNA sense sequence
gaugaagaggaauagcgac

SEQ ID NO: 2324 - RNA, 19 nt, Artificial Sequence
  siRNA antisense sequence
gucgcuauuccucuucauc

SEQ ID NO: 2325 - RNA, 19 nt, Artificial Sequence
  siRNA sense sequence
augaagaggaauagcgaca

SEQ ID NO: 2326 - RNA, 19 nt, Artificial Sequence
  siRNA antisense sequence
ugucgcuauuccucuucau

SEQ ID NO: 2327 - RNA, 19 nt, Artificial Sequence
  siRNA sense sequence
ugaagaggaauagcgacag

SEQ ID NO: 2328 - RNA, 19 nt, Artificial Sequence
  siRNA antisense sequence
cugucgcuauuccucuuca

SEQ ID NO: 2329 - RNA, 19 nt, Artificial Sequence
  siRNA sense sequence
gaagaggaauagcgacagu

SEQ ID NO: 2330 - RNA, 19 nt, Artificial Sequence
  siRNA antisense sequence
acugucgcuauuccucuuc

SEQ ID NO: 2331 - RNA, 19 nt, Artificial Sequence
  siRNA sense sequence
aagaggaauagcgacaguu

SEQ ID NO: 2332 - RNA, 19 nt, Artificial Sequence
  siRNA antisense sequence
aacugucgcuauuccucuu

SEQ ID NO: 2333 - RNA, 19 nt, Artificial Sequence
  siRNA sense sequence
ugaagaagcccagaggguu

SEQ ID NO: 2334 - RNA, 19 nt, Artificial Sequence
  siRNA antisense sequence
aacccucugggcuucuuca

SEQ ID NO: 2335 - RNA, 19 nt, Artificial Sequence
  siRNA sense sequence
gaagaagcccagaggguug

SEQ ID NO: 2336 - RNA, 19 nt, Artificial Sequence
  siRNA antisense sequence
caacccucugggcuucuuc

SEQ ID NO: 2337 - RNA, 19 nt, Artificial Sequence
  siRNA sense sequence
aagaagcccagaggguugu

SEQ ID NO: 2338 - RNA, 19 nt, Artificial Sequence
  siRNA antisense sequence
acaacccucugggcuucuu

SEQ ID NO: 2339 - RNA, 19 nt, Artificial Sequence
  siRNA sense sequence
agaagcccagaggguugug

SEQ ID NO: 2340 - RNA, 19 nt, Artificial Sequence
  siRNA antisense sequence
cacaacccucugggcuucu

SEQ ID NO: 2341 - RNA, 19 nt, Artificial Sequence
  siRNA sense sequence
gaagcccagaggguugugc

SEQ ID NO: 2342 - RNA, 19 nt, Artificial Sequence
  siRNA antisense sequence
gcacaacccucugggcuuc

SEQ ID NO: 2343 - RNA, 19 nt, Artificial Sequence
  siRNA sense sequence
aagcccagaggguugugcc

SEQ ID NO: 2344 - RNA, 19 nt, Artificial Sequence
  siRNA antisense sequence
ggcacaacccucugggcuu

SEQ ID NO: 2345 - RNA, 19 nt, Artificial Sequence
  siRNA sense sequence
aucauugccuaguguucac

SEQ ID NO: 2346 - RNA, 19 nt, Artificial Sequence
  siRNA antisense sequence
gugaacacuaggcaaugau

SEQ ID NO: 2347 - RNA, 19 nt, Artificial Sequence
  siRNA sense sequence
ucauugccuaguguucacc

SEQ ID NO: 2348 - RNA, 19 nt, Artificial Sequence
  siRNA antisense sequence
ggugaacacuaggcaauga

SEQ ID NO: 2349 - RNA, 19 nt, Artificial Sequence
  siRNA sense sequence
ugccuaguguucaccggcu

SEQ ID NO: 2350 - RNA, 19 nt, Artificial Sequence
  siRNA antisense sequence
agccggugaacacuaggca

SEQ ID NO: 2351 - RNA, 19 nt, Artificial Sequence
  siRNA sense sequence
gccuaguguucaccggcug

SEQ ID NO: 2352 - RNA, 19 nt, Artificial Sequence
  siRNA antisense sequence
cagccggugaacacuaggc

SEQ ID NO: 2353 - RNA, 19 nt, Artificial Sequence
  siRNA sense sequence
ccuaguguucaccggcuga

SEQ ID NO: 2354 - RNA, 19 nt, Artificial Sequence
  siRNA antisense sequence
ucagccggugaacacuagg

SEQ ID NO: 2355 - RNA, 19 nt, Artificial Sequence
  siRNA sense sequence
cuaguguucaccggcugac

SEQ ID NO: 2356 - RNA, 19 nt, Artificial Sequence
  siRNA antisense sequence
gucagccggugaacacuag

SEQ ID NO: 2357 - RNA, 19 nt, Artificial Sequence
  siRNA sense sequence
uaguguucaccggcugacu

SEQ ID NO: 2358 - RNA, 19 nt, Artificial Sequence
  siRNA antisense sequence
agucagccggugaacacua

SEQ ID NO: 2359 - RNA, 19 nt, Artificial Sequence
  siRNA sense sequence
aguguucaccggcugacuc

SEQ ID NO: 2360 - RNA, 19 nt, Artificial Sequence
  siRNA antisense sequence
gagucagccggugaacacu

SEQ ID NO: 2361 - RNA, 19 nt, Artificial Sequence
  siRNA sense sequence
guguucaccggcugacucu

SEQ ID NO: 2362 - RNA, 19 nt, Artificial Sequence
  siRNA antisense sequence
agagucagccggugaacac

SEQ ID NO: 2363 - RNA, 19 nt, Artificial Sequence
  siRNA sense sequence
uguucaccggcugacucuc

SEQ ID NO: 2364 - RNA, 19 nt, Artificial Sequence
  siRNA antisense sequence
gagagucagccggugaaca

SEQ ID NO: 2365 - RNA, 19 nt, Artificial Sequence
  siRNA sense sequence
guucaccggcugacucuca

SEQ ID NO: 2366 - RNA, 19 nt, Artificial Sequence
  siRNA antisense sequence
ugagagucagccggugaac

SEQ ID NO: 2367 - RNA, 19 nt, Artificial Sequence
  siRNA sense sequence
uucaccggcugacucucaa

SEQ ID NO: 2368 - RNA, 19 nt, Artificial Sequence
  siRNA antisense sequence
uugagagucagccggugaa

SEQ ID NO: 2369 - RNA, 19 nt, Artificial Sequence
  siRNA sense sequence
ucaccggcugacucucaac

SEQ ID NO: 2370 - RNA, 19 nt, Artificial Sequence
  siRNA antisense sequence
guugagagucagccgguga

SEQ ID NO: 2371 - RNA, 19 nt, Artificial Sequence
  siRNA sense sequence
caccggcugacucucaacu

SEQ ID NO: 2372 - RNA, 19 nt, Artificial Sequence
  siRNA antisense sequence
aguugagagucagccggug

SEQ ID NO: 2373 - RNA, 19 nt, Artificial Sequence
  siRNA sense sequence
accggcugacucucaacug

SEQ ID NO: 2374 - RNA, 19 nt, Artificial Sequence
  siRNA antisense sequence
caguugagagucagccggu

SEQ ID NO: 2375 - RNA, 19 nt, Artificial Sequence
  siRNA sense sequence
ccggcugacucucaacuga

SEQ ID NO: 2376 - RNA, 19 nt, Artificial Sequence
  siRNA antisense sequence
ucaguugagagucagccgg

SEQ ID NO: 2377 - RNA, 19 nt, Artificial Sequence
  siRNA sense sequence
ugacucucaacugaccauu

SEQ ID NO: 2378 - RNA, 19 nt, Artificial Sequence
  siRNA antisense sequence
aauggucaguugagaguca

SEQ ID NO: 2379 - RNA, 19 nt, Artificial Sequence
  siRNA sense sequence
gacucucaacugaccauuc

SEQ ID NO: 2380 - RNA, 19 nt, Artificial Sequence
  siRNA antisense sequence
gaauggucaguugagaguc

SEQ ID NO: 2381 - RNA, 19 nt, Artificial Sequence
  siRNA sense sequence
cucaacugaccauucccau

SEQ ID NO: 2382 - RNA, 19 nt, Artificial Sequence
  siRNA antisense sequence
augggaauggucaguugag

SEQ ID NO: 2383 - RNA, 19 nt, Artificial Sequence
  siRNA sense sequence
ucaacugaccauucccaug

SEQ ID NO: 2384 - RNA, 19 nt, Artificial Sequence
  siRNA antisense sequence
caugggaauggucaguuga

SEQ ID NO: 2385 - RNA, 19 nt, Artificial Sequence
  siRNA sense sequence
caacugaccauucccaugu

SEQ ID NO: 2386 - RNA, 19 nt, Artificial Sequence
  siRNA antisense sequence
acaugggaauggucaguug

SEQ ID NO: 2387 - RNA, 19 nt, Artificial Sequence
  siRNA sense sequence
aacugaccauucccaugug

SEQ ID NO: 2388 - RNA, 19 nt, Artificial Sequence
  siRNA antisense sequence
cacaugggaauggucaguu

SEQ ID NO: 2389 - RNA, 19 nt, Artificial Sequence
  siRNA sense sequence
acugaccauucccaugugg

SEQ ID NO: 2390 - RNA, 19 nt, Artificial Sequence
  siRNA antisense sequence
ccacaugggaauggucagu

SEQ ID NO: 2391 - RNA, 19 nt, Artificial Sequence
  siRNA sense sequence
cugaccauucccaugugga

SEQ ID NO: 2392 - RNA, 19 nt, Artificial Sequence
  siRNA antisense sequence
uccacaugggaauggucag

SEQ ID NO: 2393 - RNA, 19 nt, Artificial Sequence
  siRNA sense sequence
ugaccauucccauguggac

SEQ ID NO: 2394 - RNA, 19 nt, Artificial Sequence
  siRNA antisense sequence
guccacaugggaaugguca

SEQ ID NO: 2395 - RNA, 19 nt, Artificial Sequence
  siRNA sense sequence
gaccauucccauguggaca

SEQ ID NO: 2396 - RNA, 19 nt, Artificial Sequence
  siRNA antisense sequence
uguccacaugggaaugguc

SEQ ID NO: 2397 - RNA, 19 nt, Artificial Sequence
  siRNA sense sequence
accauucccauguggacag

SEQ ID NO: 2398 - RNA, 19 nt, Artificial Sequence
  siRNA antisense sequence
cuguccacaugggaauggu

SEQ ID NO: 2399 - RNA, 19 nt, Artificial Sequence
  siRNA sense sequence
ccauucccauguggacagg

SEQ ID NO: 2400 - RNA, 19 nt, Artificial Sequence
  siRNA antisense sequence
ccuguccacaugggaaugg

SEQ ID NO: 2401 - RNA, 19 nt, Artificial Sequence
  siRNA sense sequence
cauucccauguggacaggc

SEQ ID NO: 2402 - RNA, 19 nt, Artificial Sequence
  siRNA antisense sequence
gccuguccacaugggaaug

SEQ ID NO: 2403 - RNA, 19 nt, Artificial Sequence
  siRNA sense sequence
auucccauguggacaggcc

SEQ ID NO: 2404 - RNA, 19 nt, Artificial Sequence
  siRNA antisense sequence
ggccuguccacaugggaau

SEQ ID NO: 2405 - RNA, 19 nt, Artificial Sequence
  siRNA sense sequence
uucccauguggacaggccu

SEQ ID NO: 2406 - RNA, 19 nt, Artificial Sequence
  siRNA antisense sequence
aggccuguccacaugggaa

SEQ ID NO: 2407 - RNA, 19 nt, Artificial Sequence
  siRNA sense sequence
ucccauguggacaggccuu

SEQ ID NO: 2408 - RNA, 19 nt, Artificial Sequence
  siRNA antisense sequence
aaggccuguccacauggga

SEQ ID NO: 2409 - RNA, 19 nt, Artificial Sequence
  siRNA sense sequence
cccauguggacaggccuua

SEQ ID NO: 2410 - RNA, 19 nt, Artificial Sequence
  siRNA antisense sequence
uaaggccuguccacauggg

SEQ ID NO: 2411 - RNA, 19 nt, Artificial Sequence
  siRNA sense sequence
cauguggacaggccuuaau

SEQ ID NO: 2412 - RNA, 19 nt, Artificial Sequence
  siRNA antisense sequence
auuaaggccuguccacaug

SEQ ID NO: 2413 - RNA, 19 nt, Artificial Sequence
  siRNA sense sequence
uguggacaggccuuaauac

SEQ ID NO: 2414 - RNA, 19 nt, Artificial Sequence
  siRNA antisense sequence
guauuaaggccuguccaca

SEQ ID NO: 2415 - RNA, 19 nt, Artificial Sequence
  siRNA sense sequence
guggacaggccuuaauacu

SEQ ID NO: 2416 - RNA, 19 nt, Artificial Sequence
  siRNA antisense sequence
aguauuaaggccuguccac

SEQ ID NO: 2417 - RNA, 19 nt, Artificial Sequence
  siRNA sense sequence
uggacaggccuuaauacug

SEQ ID NO: 2418 - RNA, 19 nt, Artificial Sequence
  siRNA antisense sequence
caguauuaaggccugucca

SEQ ID NO: 2419 - RNA, 19 nt, Artificial Sequence
  siRNA sense sequence
auccuugcucugcuggcag

SEQ ID NO: 2420 - RNA, 19 nt, Artificial Sequence
  siRNA antisense sequence
cugccagcagagcaaggau

SEQ ID NO: 2421 - RNA, 19 nt, Artificial Sequence
  siRNA sense sequence
uccuugcucugcuggcagu

SEQ ID NO: 2422 - RNA, 19 nt, Artificial Sequence
  siRNA antisense sequence
acugccagcagagcaagga

SEQ ID NO: 2423 - RNA, 19 nt, Artificial Sequence
  siRNA sense sequence
ccuugcucugcuggcaguu

SEQ ID NO: 2424 - RNA, 19 nt, Artificial Sequence
  siRNA antisense sequence
aacugccagcagagcaagg

SEQ ID NO: 2425 - RNA, 19 nt, Artificial Sequence
  siRNA sense sequence
cuugcucugcuggcaguuu

SEQ ID NO: 2426 - RNA, 19 nt, Artificial Sequence
  siRNA antisense sequence
aaacugccagcagagcaag

SEQ ID NO: 2427 - RNA, 19 nt, Artificial Sequence
  siRNA sense sequence
uugcucugcuggcaguuuc

SEQ ID NO: 2428 - RNA, 19 nt, Artificial Sequence
  siRNA antisense sequence
gaaacugccagcagagcaa

SEQ ID NO: 2429 - RNA, 19 nt, Artificial Sequence
  siRNA sense sequence
ugcucugcuggcaguuucc

SEQ ID NO: 2430 - RNA, 19 nt, Artificial Sequence
  siRNA antisense sequence
ggaaacugccagcagagca

SEQ ID NO: 2431 - RNA, 19 nt, Artificial Sequence
  siRNA sense sequence
cugcuggcaguuucccacu

SEQ ID NO: 2432 - RNA, 19 nt, Artificial Sequence
  siRNA antisense sequence
agugggaaacugccagcag

SEQ ID NO: 2433 - RNA, 19 nt, Artificial Sequence
  siRNA sense sequence
ugcuggcaguuucccacuc

SEQ ID NO: 2434 - RNA, 19 nt, Artificial Sequence
  siRNA antisense sequence
gagugggaaacugccagca

SEQ ID NO: 2435 - RNA, 19 nt, Artificial Sequence
  siRNA sense sequence
ggcaguuucccacuccuau

SEQ ID NO: 2436 - RNA, 19 nt, Artificial Sequence
  siRNA antisense sequence
auaggagugggaaacugcc

SEQ ID NO: 2437 - RNA, 19 nt, Artificial Sequence
  siRNA sense sequence
gcaguuucccacuccuaug

SEQ ID NO: 2438 - RNA, 19 nt, Artificial Sequence
  siRNA antisense sequence
cauaggagugggaaacugc

SEQ ID NO: 2439 - RNA, 19 nt, Artificial Sequence
  siRNA sense sequence
caguuucccacuccuaugc

SEQ ID NO: 2440 - RNA, 19 nt, Artificial Sequence
  siRNA antisense sequence
gcauaggagugggaaacug

SEQ ID NO: 2441 - RNA, 19 nt, Artificial Sequence
  siRNA sense sequence
cuccuaugcacuuucacag

SEQ ID NO: 2442 - RNA, 19 nt, Artificial Sequence
  siRNA antisense sequence
cugugaaagugcauaggag

SEQ ID NO: 2443 - RNA, 19 nt, Artificial Sequence
  siRNA sense sequence
uccuaugcacuuucacagg

SEQ ID NO: 2444 - RNA, 19 nt, Artificial Sequence
  siRNA antisense sequence
ccugugaaagugcauagga

SEQ ID NO: 2445 - RNA, 19 nt, Artificial Sequence
  siRNA sense sequence
ccuaugcacuuucacagga

SEQ ID NO: 2446 - RNA, 19 nt, Artificial Sequence
  siRNA antisense sequence
uccugugaaagugcauagg

SEQ ID NO: 2447 - RNA, 19 nt, Artificial Sequence
  siRNA sense sequence
cuaugcacuuucacaggaa

SEQ ID NO: 2448 - RNA, 19 nt, Artificial Sequence
  siRNA antisense sequence
uuccugugaaagugcauag

SEQ ID NO: 2449 - RNA, 19 nt, Artificial Sequence
  siRNA sense sequence
auaccauccguguugaccc

SEQ ID NO: 2450 - RNA, 19 nt, Artificial Sequence
  siRNA antisense sequence
gggucaacacggaugguau

SEQ ID NO: 2451 - RNA, 19 nt, Artificial Sequence
  siRNA sense sequence
uaccauccguguugaccca

SEQ ID NO: 2452 - RNA, 19 nt, Artificial Sequence
  siRNA antisense sequence
ugggucaacacggauggua

SEQ ID NO: 2453 - RNA, 19 nt, Artificial Sequence
  siRNA sense sequence
accauccguguugacccau

SEQ ID NO: 2454 - RNA, 19 nt, Artificial Sequence
  siRNA antisense sequence
augggucaacacggauggu

SEQ ID NO: 2455 - RNA, 19 nt, Artificial Sequence
  siRNA sense sequence
ccauccguguugacccaug

SEQ ID NO: 2456 - RNA, 19 nt, Artificial Sequence
  siRNA antisense sequence
caugggucaacacggaugg

SEQ ID NO: 2457 - RNA, 19 nt, Artificial Sequence
  siRNA sense sequence
cauccguguugacccaugu

SEQ ID NO: 2458 - RNA, 19 nt, Artificial Sequence
  siRNA antisense sequence
acaugggucaacacggaug

SEQ ID NO: 2459 - RNA, 19 nt, Artificial Sequence
  siRNA sense sequence
auccguguugacccauguu

SEQ ID NO: 2460 - RNA, 19 nt, Artificial Sequence
  siRNA antisense sequence
aacaugggucaacacggau

SEQ ID NO: 2461 - RNA, 19 nt, Artificial Sequence
  siRNA sense sequence
uccguguugacccauguug

SEQ ID NO: 2462 - RNA, 19 nt, Artificial Sequence
  siRNA antisense sequence
caacaugggucaacacgga

SEQ ID NO: 2463 - RNA, 19 nt, Artificial Sequence
  siRNA sense sequence
ccguguugacccauguugc

SEQ ID NO: 2464 - RNA, 19 nt, Artificial Sequence
  siRNA antisense sequence
gcaacaugggucaacacgg

SEQ ID NO: 2465 - RNA, 19 nt, Artificial Sequence
  siRNA sense sequence
cguguugacccauguugca

SEQ ID NO: 2466 - RNA, 19 nt, Artificial Sequence
  siRNA antisense sequence
ugcaacaugggucaacacg

SEQ ID NO: 2467 - RNA, 19 nt, Artificial Sequence
  siRNA sense sequence
guguugacccauguugcag

SEQ ID NO: 2468 - RNA, 19 nt, Artificial Sequence
  siRNA antisense sequence
cugcaacaugggucaacac

SEQ ID NO: 2469 - RNA, 19 nt, Artificial Sequence
  siRNA sense sequence
uguugacccauguugcaga

SEQ ID NO: 2470 - RNA, 19 nt, Artificial Sequence
  siRNA antisense sequence
ucugcaacaugggucaaca

SEQ ID NO: 2471 - RNA, 19 nt, Artificial Sequence
  siRNA sense sequence
guugacccauguugcagag

SEQ ID NO: 2472 - RNA, 19 nt, Artificial Sequence
  siRNA antisense sequence
cucugcaacaugggucaac

SEQ ID NO: 2473 - RNA, 19 nt, Artificial Sequence
  siRNA sense sequence
uugacccauguugcagagc

SEQ ID NO: 2474 - RNA, 19 nt, Artificial Sequence
  siRNA antisense sequence
gcucugcaacaugggucaa

SEQ ID NO: 2475 - RNA, 19 nt, Artificial Sequence
  siRNA sense sequence
cccauguugcagagcccuu

SEQ ID NO: 2476 - RNA, 19 nt, Artificial Sequence
  siRNA antisense sequence
aagggcucugcaacauggg

SEQ ID NO: 2477 - RNA, 19 nt, Artificial Sequence
  siRNA sense sequence
ccauguugcagagcccuua

SEQ ID NO: 2478 - RNA, 19 nt, Artificial Sequence
  siRNA antisense sequence
uaagggcucugcaacaugg

SEQ ID NO: 2479 - RNA, 19 nt, Artificial Sequence
  siRNA sense sequence
cauguugcagagcccuuac

SEQ ID NO: 2480 - RNA, 19 nt, Artificial Sequence
  siRNA antisense sequence
guaagggcucugcaacaug

SEQ ID NO: 2481 - RNA, 19 nt, Artificial Sequence
  siRNA sense sequence
auguugcagagcccuuacu

SEQ ID NO: 2482 - RNA, 19 nt, Artificial Sequence
  siRNA antisense sequence
aguaagggcucugcaacau

SEQ ID NO: 2483 - RNA, 19 nt, Artificial Sequence
  siRNA sense sequence
uguugcagagcccuuacuu

SEQ ID NO: 2484 - RNA, 19 nt, Artificial Sequence
  siRNA antisense sequence
aaguaagggcucugcaaca

SEQ ID NO: 2485 - RNA, 19 nt, Artificial Sequence
  siRNA sense sequence
guugcagagcccuuacuua

SEQ ID NO: 2486 - RNA, 19 nt, Artificial Sequence
  siRNA antisense sequence
uaaguaagggcucugcaac

SEQ ID NO: 2487 - RNA, 19 nt, Artificial Sequence
  siRNA sense sequence
uugcagagcccuuacuuaa

SEQ ID NO: 2488 - RNA, 19 nt, Artificial Sequence
  siRNA antisense sequence
uuaaguaagggcucugcaa

SEQ ID NO: 2489 - RNA, 19 nt, Artificial Sequence
  siRNA sense sequence
ugcagagcccuuacuuaaa

SEQ ID NO: 2490 - RNA, 19 nt, Artificial Sequence
  siRNA antisense sequence
uuuaaguaagggcucugca

SEQ ID NO: 2491 - RNA, 19 nt, Artificial Sequence
  siRNA sense sequence
cagagcccuuacuuaaauc

SEQ ID NO: 2492 - RNA, 19 nt, Artificial Sequence
  siRNA antisense sequence
gauuuaaguaagggcucug

SEQ ID NO: 2493 - RNA, 19 nt, Artificial Sequence
  siRNA sense sequence
cccuuacuuaaauccuuca

SEQ ID NO: 2494 - RNA, 19 nt, Artificial Sequence
  siRNA antisense sequence
ugaaggauuuaaguaaggg

SEQ ID NO: 2495 - RNA, 19 nt, Artificial Sequence
  siRNA sense sequence
cuuacuuaaauccuucacu

SEQ ID NO: 2496 - RNA, 19 nt, Artificial Sequence
  siRNA antisense sequence
agugaaggauuuaaguaag

SEQ ID NO: 2497 - RNA, 19 nt, Artificial Sequence
  siRNA sense sequence
uuacuuaaauccuucacug

SEQ ID NO: 2498 - RNA, 19 nt, Artificial Sequence
  siRNA antisense sequence
cagugaaggauuuaaguaa

SEQ ID NO: 2499 - RNA, 19 nt, Artificial Sequence
  siRNA sense sequence
uuaaauccuucacuggugu

SEQ ID NO: 2500 - RNA, 19 nt, Artificial Sequence
  siRNA antisense sequence
acaccagugaaggauuuaa

SEQ ID NO: 2501 - RNA, 19 nt, Artificial Sequence
  siRNA sense sequence
uaaauccuucacuggugua

SEQ ID NO: 2502 - RNA, 19 nt, Artificial Sequence
  siRNA antisense sequence
uacaccagugaaggauuua

SEQ ID NO: 2503 - RNA, 19 nt, Artificial Sequence
  siRNA sense sequence
aaauccuucacugguguau

SEQ ID NO: 2504 - RNA, 19 nt, Artificial Sequence
  siRNA antisense sequence
auacaccagugaaggauuu

SEQ ID NO: 2505 - RNA, 19 nt, Artificial Sequence
  siRNA sense sequence
aauccuucacugguguaug

SEQ ID NO: 2506 - RNA, 19 nt, Artificial Sequence
  siRNA antisense sequence
cauacaccagugaaggauu

SEQ ID NO: 2507 - RNA, 19 nt, Artificial Sequence
  siRNA sense sequence
auccuucacugguguauga

SEQ ID NO: 2508 - RNA, 19 nt, Artificial Sequence
  siRNA antisense sequence
ucauacaccagugaaggau

SEQ ID NO: 2509 - RNA, 19 nt, Artificial Sequence
  siRNA sense sequence
ucacugguguaugaauacu

SEQ ID NO: 2510 - RNA, 19 nt, Artificial Sequence
  siRNA antisense sequence
aguauucauacaccaguga

SEQ ID NO: 2511 - RNA, 19 nt, Artificial Sequence
  siRNA sense sequence
cacugguguaugaauacuu

SEQ ID NO: 2512 - RNA, 19 nt, Artificial Sequence
  siRNA antisense sequence
aaguauucauacaccagug

SEQ ID NO: 2513 - RNA, 19 nt, Artificial Sequence
  siRNA sense sequence
acugguguaugaauacuuu

SEQ ID NO: 2514 - RNA, 19 nt, Artificial Sequence
  siRNA antisense sequence
aaaguauucauacaccagu

SEQ ID NO: 2515 - RNA, 19 nt, Artificial Sequence
  siRNA sense sequence
cugguguaugaauacuuug

SEQ ID NO: 2516 - RNA, 19 nt, Artificial Sequence
  siRNA antisense sequence
caaaguauucauacaccag

SEQ ID NO: 2517 - RNA, 19 nt, Artificial Sequence
  siRNA sense sequence
ugguguaugaauacuuugu

SEQ ID NO: 2518 - RNA, 19 nt, Artificial Sequence
  siRNA antisense sequence
acaaaguauucauacacca

SEQ ID NO: 2519 - RNA, 19 nt, Artificial Sequence
  siRNA sense sequence
guguaugaauacuuuguca

SEQ ID NO: 2520 - RNA, 19 nt, Artificial Sequence
  siRNA antisense sequence
ugacaaaguauucauacac

SEQ ID NO: 2521 - RNA, 19 nt, Artificial Sequence
  siRNA sense sequence
gaauacuuugucauaaugc

SEQ ID NO: 2522 - RNA, 19 nt, Artificial Sequence
  siRNA antisense sequence
gcauuaugacaaaguauuc

SEQ ID NO: 2523 - RNA, 19 nt, Artificial Sequence
  siRNA sense sequence
auacuuugucauaaugcug

SEQ ID NO: 2524 - RNA, 19 nt, Artificial Sequence
  siRNA antisense sequence
cagcauuaugacaaaguau

SEQ ID NO: 2525 - RNA, 19 nt, Artificial Sequence
  siRNA sense sequence
ucauaaugcugcuuugcug

SEQ ID NO: 2526 - RNA, 19 nt, Artificial Sequence
  siRNA antisense sequence
cagcaaagcagcauuauga

SEQ ID NO: 2527 - RNA, 19 nt, Artificial Sequence
  siRNA sense sequence
aaugcugcuuugcugggua

SEQ ID NO: 2528 - RNA, 19 nt, Artificial Sequence
  siRNA antisense sequence
uacccagcaaagcagcauu

SEQ ID NO: 2529 - RNA, 19 nt, Artificial Sequence
  siRNA sense sequence
augcugcuuugcuggguag

SEQ ID NO: 2530 - RNA, 19 nt, Artificial Sequence
  siRNA antisense sequence
cuacccagcaaagcagcau

SEQ ID NO: 2531 - RNA, 19 nt, Artificial Sequence
  siRNA sense sequence
ugcugcuuugcuggguagu

SEQ ID NO: 2532 - RNA, 19 nt, Artificial Sequence
  siRNA antisense sequence
acuacccagcaaagcagca

SEQ ID NO: 2533 - RNA, 19 nt, Artificial Sequence
  siRNA sense sequence
gcugcuuugcuggguagug

SEQ ID NO: 2534 - RNA, 19 nt, Artificial Sequence
  siRNA antisense sequence
cacuacccagcaaagcagc

SEQ ID NO: 2535 - RNA, 19 nt, Artificial Sequence
  siRNA sense sequence
cugcuuugcuggguaguga

SEQ ID NO: 2536 - RNA, 19 nt, Artificial Sequence
  siRNA antisense sequence
ucacuacccagcaaagcag

SEQ ID NO: 2537 - RNA, 19 nt, Artificial Sequence
  siRNA sense sequence
ugcuuugcuggguagugag

SEQ ID NO: 2538 - RNA, 19 nt, Artificial Sequence
  siRNA antisense sequence
cucacuacccagcaaagca

SEQ ID NO: 2539 - RNA, 19 nt, Artificial Sequence
  siRNA sense sequence
gcuuugcuggguagugagc

SEQ ID NO: 2540 - RNA, 19 nt, Artificial Sequence
  siRNA antisense sequence
gcucacuacccagcaaagc

SEQ ID NO: 2541 - RNA, 19 nt, Artificial Sequence
  siRNA sense sequence
cuuugcuggguagugagcu

SEQ ID NO: 2542 - RNA, 19 nt, Artificial Sequence
  siRNA antisense sequence
agcucacuacccagcaaag

SEQ ID NO: 2543 - RNA, 19 nt, Artificial Sequence
  siRNA sense sequence
uuugcuggguagugagcuc

SEQ ID NO: 2544 - RNA, 19 nt, Artificial Sequence
  siRNA antisense sequence
gagcucacuacccagcaaa

SEQ ID NO: 2545 - RNA, 19 nt, Artificial Sequence
  siRNA sense sequence
uugcuggguagugagcucu

SEQ ID NO: 2546 - RNA, 19 nt, Artificial Sequence
  siRNA antisense sequence
agagcucacuacccagcaa

SEQ ID NO: 2547 - RNA, 19 nt, Artificial Sequence
  siRNA sense sequence
ugcuggguagugagcucuu

SEQ ID NO: 2548 - RNA, 19 nt, Artificial Sequence
  siRNA antisense sequence
aagagcucacuacccagca

SEQ ID NO: 2549 - RNA, 19 nt, Artificial Sequence
  siRNA sense sequence
gcuggguagugagcucuua

SEQ ID NO: 2550 - RNA, 19 nt, Artificial Sequence
  siRNA antisense sequence
uaagagcucacuacccagc

SEQ ID NO: 2551 - RNA, 19 nt, Artificial Sequence
  siRNA sense sequence
cuggguagugagcucuuau

SEQ ID NO: 2552 - RNA, 19 nt, Artificial Sequence
  siRNA antisense sequence
auaagagcucacuacccag

SEQ ID NO: 2553 - RNA, 19 nt, Artificial Sequence
  siRNA sense sequence
uggguagugagcucuuauu

SEQ ID NO: 2554 - RNA, 19 nt, Artificial Sequence
  siRNA antisense sequence
aauaagagcucacuaccca

SEQ ID NO: 2555 - RNA, 19 nt, Artificial Sequence
  siRNA sense sequence
aacucaagugacauauuuc

SEQ ID NO: 2556 - RNA, 19 nt, Artificial Sequence
  siRNA antisense sequence
gaaauaugucacuugaguu

SEQ ID NO: 2557 - RNA, 19 nt, Artificial Sequence
  siRNA sense sequence
caagugacauauuucaguu

SEQ ID NO: 2558 - RNA, 19 nt, Artificial Sequence
  siRNA antisense sequence
aacugaaauaugucacuug

SEQ ID NO: 2559 - RNA, 19 nt, Artificial Sequence
  siRNA sense sequence
agugacauauuucaguuac

SEQ ID NO: 2560 - RNA, 19 nt, Artificial Sequence
  siRNA antisense sequence
guaacugaaauaugucacu

SEQ ID NO: 2561 - RNA, 19 nt, Artificial Sequence
  siRNA sense sequence
gugacauauuucaguuacc

SEQ ID NO: 2562 - RNA, 19 nt, Artificial Sequence
  siRNA antisense sequence
gguaacugaaauaugucac

SEQ ID NO: 2563 - RNA, 19 nt, Artificial Sequence
  siRNA sense sequence
gacauauuucaguuaccaa

SEQ ID NO: 2564 - RNA, 19 nt, Artificial Sequence
  siRNA antisense sequence
uugguaacugaaauauguc

SEQ ID NO: 2565 - RNA, 19 nt, Artificial Sequence
  siRNA sense sequence
auuucaguuaccaaagugg

SEQ ID NO: 2566 - RNA, 19 nt, Artificial Sequence
  siRNA antisense sequence
ccacuuugguaacugaaau

SEQ ID NO: 2567 - RNA, 19 nt, Artificial Sequence
  siRNA sense sequence
caguuaccaaaguggccag

SEQ ID NO: 2568 - RNA, 19 nt, Artificial Sequence
  siRNA antisense sequence
cuggccacuuugguaacug

SEQ ID NO: 2569 - RNA, 19 nt, Artificial Sequence
  siRNA sense sequence
auauuguauuucccagugu

SEQ ID NO: 2570 - RNA, 19 nt, Artificial Sequence
  siRNA antisense sequence
acacugggaaauacaauau

SEQ ID NO: 2571 - RNA, 19 nt, Artificial Sequence
  siRNA sense sequence
uauuguauuucccagugug

SEQ ID NO: 2572 - RNA, 19 nt, Artificial Sequence
  siRNA antisense sequence
cacacugggaaauacaaua

SEQ ID NO: 2573 - RNA, 19 nt, Artificial Sequence
  siRNA sense sequence
guauuucccagugugucuu

SEQ ID NO: 2574 - RNA, 19 nt, Artificial Sequence
  siRNA antisense sequence
aagacacacugggaaauac

SEQ ID NO: 2575 - RNA, 19 nt, Artificial Sequence
  siRNA sense sequence
uucccagugugucuuuuau

SEQ ID NO: 2576 - RNA, 19 nt, Artificial Sequence
  siRNA antisense sequence
auaaaagacacacugggaa

SEQ ID NO: 2577 - RNA, 19 nt, Artificial Sequence
  siRNA sense sequence
ucccagugugucuuuuaug

SEQ ID NO: 2578 - RNA, 19 nt, Artificial Sequence
  siRNA antisense sequence
cauaaaagacacacuggga

SEQ ID NO: 2579 - RNA, 19 nt, Artificial Sequence
  siRNA sense sequence
cccagugugucuuuuaugu

SEQ ID NO: 2580 - RNA, 19 nt, Artificial Sequence
  siRNA antisense sequence
acauaaaagacacacuggg

SEQ ID NO: 2581 - RNA, 19 nt, Artificial Sequence
  siRNA sense sequence
agugugucuuuuaugucuu

SEQ ID NO: 2582 - RNA, 19 nt, Artificial Sequence
  siRNA antisense sequence
aagacauaaaagacacacu

SEQ ID NO: 2583 - RNA, 19 nt, Artificial Sequence
  siRNA sense sequence
gucuuugaauguuuuggag

SEQ ID NO: 2584 - RNA, 19 nt, Artificial Sequence
  siRNA antisense sequence
cuccaaaacauucaaagac

SEQ ID NO: 2585 - RNA, 19 nt, Artificial Sequence
  siRNA sense sequence
aaaagucuaugccugucua

SEQ ID NO: 2586 - RNA, 19 nt, Artificial Sequence
  siRNA antisense sequence
uagacaggcauagacuuuu

SEQ ID NO: 2587 - RNA, 19 nt, Artificial Sequence
  siRNA sense sequence
aaagucuaugccugucuaa

SEQ ID NO: 2588 - RNA, 19 nt, Artificial Sequence
  siRNA antisense sequence
uuagacaggcauagacuuu

SEQ ID NO: 2589 - RNA, 19 nt, Artificial Sequence
  siRNA sense sequence
aagucuaugccugucuaaa

SEQ ID NO: 2590 - RNA, 19 nt, Artificial Sequence
  siRNA antisense sequence
uuuagacaggcauagacuu

SEQ ID NO: 2591 - RNA, 19 nt, Artificial Sequence
  siRNA sense sequence
agucuaugccugucuaaaa

SEQ ID NO: 2592 - RNA, 19 nt, Artificial Sequence
  siRNA antisense sequence
uuuuagacaggcauagacu

SEQ ID NO: 2593 - RNA, 19 nt, Artificial Sequence
  siRNA sense sequence
aaaugaauccaguguugcc

SEQ ID NO: 2594 - RNA, 19 nt, Artificial Sequence
  siRNA antisense sequence
ggcaacacuggauucauuu

SEQ ID NO: 2595 - RNA, 19 nt, Artificial Sequence
  siRNA sense sequence
aaugaauccaguguugccu

SEQ ID NO: 2596 - RNA, 19 nt, Artificial Sequence
  siRNA antisense sequence
aggcaacacuggauucauu

SEQ ID NO: 2597 - RNA, 19 nt, Artificial Sequence
  siRNA sense sequence
uccaguguugccuuucuga

SEQ ID NO: 2598 - RNA, 19 nt, Artificial Sequence
  siRNA antisense sequence
ucagaaaggcaacacugga

SEQ ID NO: 2599 - RNA, 19 nt, Artificial Sequence
  siRNA sense sequence
ccaguguugccuuucugag

SEQ ID NO: 2600 - RNA, 19 nt, Artificial Sequence
  siRNA antisense sequence
cucagaaaggcaacacugg

SEQ ID NO: 2601 - RNA, 19 nt, Artificial Sequence
  siRNA sense sequence
caguguugccuuucugagg

SEQ ID NO: 2602 - RNA, 19 nt, Artificial Sequence
  siRNA antisense sequence
ccucagaaaggcaacacug

SEQ ID NO: 2603 - RNA, 19 nt, Artificial Sequence
  siRNA sense sequence
aguguugccuuucugaggg

SEQ ID NO: 2604 - RNA, 19 nt, Artificial Sequence
  siRNA antisense sequence
cccucagaaaggcaacacu

SEQ ID NO: 2605 - RNA, 19 nt, Artificial Sequence
  siRNA sense sequence
guguugccuuucugaggga

SEQ ID NO: 2606 - RNA, 19 nt, Artificial Sequence
  siRNA antisense sequence
ucccucagaaaggcaacac

SEQ ID NO: 2607 - RNA, 19 nt, Artificial Sequence
  siRNA sense sequence
ugccuuucugagggauuuc

SEQ ID NO: 2608 - RNA, 19 nt, Artificial Sequence
  siRNA antisense sequence
gaaaucccucagaaaggca

SEQ ID NO: 2609 - RNA, 19 nt, Artificial Sequence
  siRNA sense sequence
gccuuucugagggauuucu

SEQ ID NO: 2610 - RNA, 19 nt, Artificial Sequence
  siRNA antisense sequence
agaaaucccucagaaaggc

SEQ ID NO: 2611 - RNA, 19 nt, Artificial Sequence
  siRNA sense sequence
ccuuucugagggauuucug

SEQ ID NO: 2612 - RNA, 19 nt, Artificial Sequence
  siRNA antisense sequence
cagaaaucccucagaaagg

SEQ ID NO: 2613 - RNA, 19 nt, Artificial Sequence
  siRNA sense sequence
cuuucugagggauuucugc

SEQ ID NO: 2614 - RNA, 19 nt, Artificial Sequence
  siRNA antisense sequence
gcagaaaucccucagaaag

SEQ ID NO: 2615 - RNA, 19 nt, Artificial Sequence
  siRNA sense sequence
uuucugagggauuucugcu

SEQ ID NO: 2616 - RNA, 19 nt, Artificial Sequence
  siRNA antisense sequence
agcagaaaucccucagaaa

SEQ ID NO: 2617 - RNA, 19 nt, Artificial Sequence
  siRNA sense sequence
uucugagggauuucugcuc

SEQ ID NO: 2618 - RNA, 19 nt, Artificial Sequence
  siRNA antisense sequence
gagcagaaaucccucagaa

SEQ ID NO: 2619 - RNA, 19 nt, Artificial Sequence
  siRNA sense sequence
gagggauuucugcucaaug

SEQ ID NO: 2620 - RNA, 19 nt, Artificial Sequence
  siRNA antisense sequence
cauugagcagaaaucccuc

SEQ ID NO: 2621 - RNA, 19 nt, Artificial Sequence
  siRNA sense sequence
agggauuucugcucaaugc

SEQ ID NO: 2622 - RNA, 19 nt, Artificial Sequence
  siRNA antisense sequence
gcauugagcagaaaucccu

SEQ ID NO: 2623 - RNA, 19 nt, Artificial Sequence
  siRNA sense sequence
gcucaaugcaauacacugu

SEQ ID NO: 2624 - RNA, 19 nt, Artificial Sequence
  siRNA antisense sequence
acaguguauugcauugagc

SEQ ID NO: 2625 - RNA, 19 nt, Artificial Sequence
  siRNA sense sequence
augcaauacacuguucagu

SEQ ID NO: 2626 - RNA, 19 nt, Artificial Sequence
  siRNA antisense sequence
acugaacaguguauugcau

SEQ ID NO: 2627 - RNA, 19 nt, Artificial Sequence
  siRNA sense sequence
acuguucagugcuauucuc

SEQ ID NO: 2628 - RNA, 19 nt, Artificial Sequence
  siRNA antisense sequence
gagaauagcacugaacagu

SEQ ID NO: 2629 - RNA, 19 nt, Artificial Sequence
  siRNA sense sequence
cuguucagugcuauucucc

SEQ ID NO: 2630 - RNA, 19 nt, Artificial Sequence
  siRNA antisense sequence
ggagaauagcacugaacag

SEQ ID NO: 2631 - RNA, 19 nt, Artificial Sequence
  siRNA sense sequence
uguucagugcuauucuccc

SEQ ID NO: 2632 - RNA, 19 nt, Artificial Sequence
  siRNA antisense sequence
gggagaauagcacugaaca

SEQ ID NO: 2633 - RNA, 19 nt, Artificial Sequence
  siRNA sense sequence
agugcuauucucccagcua

SEQ ID NO: 2634 - RNA, 19 nt, Artificial Sequence
  siRNA antisense sequence
uagcugggagaauagcacu

SEQ ID NO: 2635 - RNA, 19 nt, Artificial Sequence
  siRNA sense sequence
gugcuauucucccagcuag

SEQ ID NO: 2636 - RNA, 19 nt, Artificial Sequence
  siRNA antisense sequence
cuagcugggagaauagcac

SEQ ID NO: 2637 - RNA, 19 nt, Artificial Sequence
  siRNA sense sequence
ugcuauucucccagcuagg

SEQ ID NO: 2638 - RNA, 19 nt, Artificial Sequence
  siRNA antisense sequence
ccuagcugggagaauagca

SEQ ID NO: 2639 - RNA, 19 nt, Artificial Sequence
  siRNA sense sequence
gcuauucucccagcuaggu

SEQ ID NO: 2640 - RNA, 19 nt, Artificial Sequence
  siRNA antisense sequence
accuagcugggagaauagc

SEQ ID NO: 2641 - RNA, 19 nt, Artificial Sequence
  siRNA sense sequence
cuauucucccagcuagguu

SEQ ID NO: 2642 - RNA, 19 nt, Artificial Sequence
  siRNA antisense sequence
aaccuagcugggagaauag

SEQ ID NO: 2643 - RNA, 19 nt, Artificial Sequence
  siRNA sense sequence
uauucucccagcuagguuu

SEQ ID NO: 2644 - RNA, 19 nt, Artificial Sequence
  siRNA antisense sequence
aaaccuagcugggagaaua

SEQ ID NO: 2645 - RNA, 19 nt, Artificial Sequence
  siRNA sense sequence
auucucccagcuagguuua

SEQ ID NO: 2646 - RNA, 19 nt, Artificial Sequence
  siRNA antisense sequence
uaaaccuagcugggagaau

SEQ ID NO: 2647 - RNA, 19 nt, Artificial Sequence
  siRNA sense sequence
uucucccagcuagguuuau

SEQ ID NO: 2648 - RNA, 19 nt, Artificial Sequence
  siRNA antisense sequence
auaaaccuagcugggagaa

SEQ ID NO: 2649 - RNA, 19 nt, Artificial Sequence
  siRNA sense sequence
ucucccagcuagguuuauc

SEQ ID NO: 2650 - RNA, 19 nt, Artificial Sequence
  siRNA antisense sequence
gauaaaccuagcugggaga

SEQ ID NO: 2651 - RNA, 19 nt, Artificial Sequence
  siRNA sense sequence
cucccagcuagguuuaucc

SEQ ID NO: 2652 - RNA, 19 nt, Artificial Sequence
  siRNA antisense sequence
ggauaaaccuagcugggag

SEQ ID NO: 2653 - RNA, 19 nt, Artificial Sequence
  siRNA sense sequence
gcuagguuuauccaugaag

SEQ ID NO: 2654 - RNA, 19 nt, Artificial Sequence
  siRNA antisense sequence
cuucauggauaaaccuagc

SEQ ID NO: 2655 - RNA, 19 nt, Artificial Sequence
  siRNA sense sequence
gguuuauccaugaaggacu

SEQ ID NO: 2656 - RNA, 19 nt, Artificial Sequence
  siRNA antisense sequence
aguccuucauggauaaacc

SEQ ID NO: 2657 - RNA, 19 nt, Artificial Sequence
  siRNA sense sequence
gugaccuuuguuguauuua

SEQ ID NO: 2658 - RNA, 19 nt, Artificial Sequence
  siRNA antisense sequence
uaaauacaacaaaggucac

SEQ ID NO: 2659 - RNA, 19 nt, Artificial Sequence
  siRNA sense sequence
gaccuuuguuguauuuaac

SEQ ID NO: 2660 - RNA, 19 nt, Artificial Sequence
  siRNA antisense sequence
guuaaauacaacaaagguc

SEQ ID NO: 2661 - RNA, 19 nt, Artificial Sequence
  siRNA sense sequence
caaaauccaggugcaucaa

SEQ ID NO: 2662 - RNA, 19 nt, Artificial Sequence
  siRNA antisense sequence
uugaugcaccuggauuuug

SEQ ID NO: 2663 - RNA, 19 nt, Artificial Sequence
  siRNA sense sequence
aaaauccaggugcaucaau

SEQ ID NO: 2664 - RNA, 19 nt, Artificial Sequence
  siRNA antisense sequence
auugaugcaccuggauuuu

SEQ ID NO: 2665 - RNA, 19 nt, Artificial Sequence
  siRNA sense sequence
aaauccaggugcaucaauu

SEQ ID NO: 2666 - RNA, 19 nt, Artificial Sequence
  siRNA antisense sequence
aauugaugcaccuggauuu

SEQ ID NO: 2667 - RNA, 19 nt, Artificial Sequence
  siRNA sense sequence
aauccaggugcaucaauuu

SEQ ID NO: 2668 - RNA, 19 nt, Artificial Sequence
  siRNA antisense sequence
aaauugaugcaccuggauu

SEQ ID NO: 2669 - RNA, 19 nt, Artificial Sequence
  siRNA sense sequence
auccaggugcaucaauuuc

SEQ ID NO: 2670 - RNA, 19 nt, Artificial Sequence
  siRNA antisense sequence
gaaauugaugcaccuggau

SEQ ID NO: 2671 - RNA, 19 nt, Artificial Sequence
  siRNA sense sequence
uccaggugcaucaauuucu

SEQ ID NO: 2672 - RNA, 19 nt, Artificial Sequence
  siRNA antisense sequence
agaaauugaugcaccugga

SEQ ID NO: 2673 - RNA, 19 nt, Artificial Sequence
  siRNA sense sequence
ccaggugcaucaauuucug

SEQ ID NO: 2674 - RNA, 19 nt, Artificial Sequence
  siRNA antisense sequence
cagaaauugaugcaccugg

SEQ ID NO: 2675 - RNA, 19 nt, Artificial Sequence
  siRNA sense sequence
caggugcaucaauuucuga

SEQ ID NO: 2676 - RNA, 19 nt, Artificial Sequence
  siRNA antisense sequence
ucagaaauugaugcaccug

SEQ ID NO: 2677 - RNA, 19 nt, Artificial Sequence
  siRNA sense sequence
guauuaucuacuaugugug

SEQ ID NO: 2678 - RNA, 19 nt, Artificial Sequence
  siRNA antisense sequence
cacacauaguagauaauac

SEQ ID NO: 2679 - RNA, 19 nt, Artificial Sequence
  siRNA sense sequence
uguguguuuuauuucugcu

SEQ ID NO: 2680 - RNA, 19 nt, Artificial Sequence
  siRNA antisense sequence
agcagaaauaaaacacaca

SEQ ID NO: 2681 - RNA, 19 nt, Artificial Sequence
  siRNA sense sequence
agaguauucagguuugcca

SEQ ID NO: 2682 - RNA, 19 nt, Artificial Sequence
  siRNA antisense sequence
uggcaaaccugaauacucu

SEQ ID NO: 2683 - RNA, 19 nt, Artificial Sequence
  siRNA sense sequence
auucagguuugccauggac

SEQ ID NO: 2684 - RNA, 19 nt, Artificial Sequence
  siRNA antisense sequence
guccauggcaaaccugaau

SEQ ID NO: 2685 - RNA, 19 nt, Artificial Sequence
  siRNA sense sequence
uucagguuugccauggaca

SEQ ID NO: 2686 - RNA, 19 nt, Artificial Sequence
  siRNA antisense sequence
uguccauggcaaaccugaa

SEQ ID NO: 2687 - RNA, 19 nt, Artificial Sequence
  siRNA sense sequence
ucagguuugccauggacau

SEQ ID NO: 2688 - RNA, 19 nt, Artificial Sequence
  siRNA antisense sequence
auguccauggcaaaccuga

SEQ ID NO: 2689 - RNA, 19 nt, Artificial Sequence
  siRNA sense sequence
uugccauggacaucagaag

SEQ ID NO: 2690 - RNA, 19 nt, Artificial Sequence
  siRNA antisense sequence
cuucugauguccauggcaa

SEQ ID NO: 2691 - RNA, 19 nt, Artificial Sequence
  siRNA sense sequence
gccauggacaucagaaguu

SEQ ID NO: 2692 - RNA, 19 nt, Artificial Sequence
  siRNA antisense sequence
aacuucugauguccauggc

SEQ ID NO: 2693 - RNA, 19 nt, Artificial Sequence
  siRNA sense sequence
ccauggacaucagaaguuu

SEQ ID NO: 2694 - RNA, 19 nt, Artificial Sequence
  siRNA antisense sequence
aaacuucugauguccaugg

SEQ ID NO: 2695 - RNA, 19 nt, Artificial Sequence
  siRNA sense sequence
cauggacaucagaaguuug

SEQ ID NO: 2696 - RNA, 19 nt, Artificial Sequence
  siRNA antisense sequence
caaacuucugauguccaug

SEQ ID NO: 2697 - RNA, 19 nt, Artificial Sequence
  siRNA sense sequence
auggacaucagaaguuuga

SEQ ID NO: 2698 - RNA, 19 nt, Artificial Sequence
  siRNA antisense sequence
ucaaacuucugauguccau

SEQ ID NO: 2699 - RNA, 19 nt, Artificial Sequence
  siRNA sense sequence
uggacaucagaaguuugaa

SEQ ID NO: 2700 - RNA, 19 nt, Artificial Sequence
  siRNA antisense sequence
uucaaacuucugaugucca

SEQ ID NO: 2701 - RNA, 19 nt, Artificial Sequence
  siRNA sense sequence
ggacaucagaaguuugaau

SEQ ID NO: 2702 - RNA, 19 nt, Artificial Sequence
  siRNA antisense sequence
auucaaacuucugaugucc

SEQ ID NO: 2703 - RNA, 19 nt, Artificial Sequence
  siRNA sense sequence
gacaucagaaguuugaauu

SEQ ID NO: 2704 - RNA, 19 nt, Artificial Sequence
  siRNA antisense sequence
aauucaaacuucugauguc

SEQ ID NO: 2705 - RNA, 19 nt, Artificial Sequence
  siRNA sense sequence
acaucagaaguuugaauuc

SEQ ID NO: 2706 - RNA, 19 nt, Artificial Sequence
  siRNA antisense sequence
gaauucaaacuucugaugu

SEQ ID NO: 2707 - RNA, 19 nt, Artificial Sequence
  siRNA sense sequence
caucagaaguuugaauucc

SEQ ID NO: 2708 - RNA, 19 nt, Artificial Sequence
  siRNA antisense sequence
ggaauucaaacuucugaug

SEQ ID NO: 2709 - RNA, 19 nt, Artificial Sequence
  siRNA sense sequence
aucagaaguuugaauucca

SEQ ID NO: 2710 - RNA, 19 nt, Artificial Sequence
  siRNA antisense sequence
uggaauucaaacuucugau

SEQ ID NO: 2711 - RNA, 19 nt, Artificial Sequence
  siRNA sense sequence
ucagaaguuugaauuccag

SEQ ID NO: 2712 - RNA, 19 nt, Artificial Sequence
  siRNA antisense sequence
cuggaauucaaacuucuga

SEQ ID NO: 2713 - RNA, 19 nt, Artificial Sequence
  siRNA sense sequence
uuccagucuuaucuuaugu

SEQ ID NO: 2714 - RNA, 19 nt, Artificial Sequence
  siRNA antisense sequence
acauaagauaagacuggaa

SEQ ID NO: 2715 - RNA, 19 nt, Artificial Sequence
  siRNA sense sequence
uccagucuuaucuuauguu

SEQ ID NO: 2716 - RNA, 19 nt, Artificial Sequence
  siRNA antisense sequence
aacauaagauaagacugga

SEQ ID NO: 2717 - RNA, 19 nt, Artificial Sequence
  siRNA sense sequence
ccagucuuaucuuauguuc

SEQ ID NO: 2718 - RNA, 19 nt, Artificial Sequence
  siRNA antisense sequence
gaacauaagauaagacugg

SEQ ID NO: 2719 - RNA, 19 nt, Artificial Sequence
  siRNA sense sequence
cagucuuaucuuauguucc

SEQ ID NO: 2720 - RNA, 19 nt, Artificial Sequence
  siRNA antisense sequence
ggaacauaagauaagacug

SEQ ID NO: 2721 - RNA, 19 nt, Artificial Sequence
  siRNA sense sequence
agucuuaucuuauguucca

SEQ ID NO: 2722 - RNA, 19 nt, Artificial Sequence
  siRNA antisense sequence
uggaacauaagauaagacu

SEQ ID NO: 2723 - RNA, 19 nt, Artificial Sequence
  siRNA sense sequence
gucuuaucuuauguuccau

SEQ ID NO: 2724 - RNA, 19 nt, Artificial Sequence
  siRNA antisense sequence
auggaacauaagauaagac

SEQ ID NO: 2725 - RNA, 19 nt, Artificial Sequence
  siRNA sense sequence
uaucuuauguuccauggcu

SEQ ID NO: 2726 - RNA, 19 nt, Artificial Sequence
  siRNA antisense sequence
agccauggaacauaagaua

SEQ ID NO: 2727 - RNA, 19 nt, Artificial Sequence
  siRNA sense sequence
aucuuauguuccauggcug

SEQ ID NO: 2728 - RNA, 19 nt, Artificial Sequence
  siRNA antisense sequence
cagccauggaacauaagau

SEQ ID NO: 2729 - RNA, 19 nt, Artificial Sequence
  siRNA sense sequence
ucuuauguuccauggcuga

SEQ ID NO: 2730 - RNA, 19 nt, Artificial Sequence
  siRNA antisense sequence
ucagccauggaacauaaga

SEQ ID NO: 2731 - RNA, 19 nt, Artificial Sequence
  siRNA sense sequence
cuuauguuccauggcugaa

SEQ ID NO: 2732 - RNA, 19 nt, Artificial Sequence
  siRNA antisense sequence
uucagccauggaacauaag

SEQ ID NO: 2733 - RNA, 19 nt, Artificial Sequence
  siRNA sense sequence
uuccauggcugaauuuuaa

SEQ ID NO: 2734 - RNA, 19 nt, Artificial Sequence
  siRNA antisense sequence
uuaaaauucagccauggaa

SEQ ID NO: 2735 - RNA, 19 nt, Artificial Sequence
  siRNA sense sequence
uccauggcugaauuuuaaa

SEQ ID NO: 2736 - RNA, 19 nt, Artificial Sequence
  siRNA antisense sequence
uuuaaaauucagccaugga

SEQ ID NO: 2737 - RNA, 19 nt, Artificial Sequence
  siRNA sense sequence
ccauggcugaauuuuaaag

SEQ ID NO: 2738 - RNA, 19 nt, Artificial Sequence
  siRNA antisense sequence
cuuuaaaauucagccaugg

SEQ ID NO: 2739 - RNA, 19 nt, Artificial Sequence
  siRNA sense sequence
cauggcugaauuuuaaagc

SEQ ID NO: 2740 - RNA, 19 nt, Artificial Sequence
  siRNA antisense sequence
gcuuuaaaauucagccaug

SEQ ID NO: 2741 - RNA, 19 nt, Artificial Sequence
  siRNA sense sequence
aaagcuguuuagguuuaac

SEQ ID NO: 2742 - RNA, 19 nt, Artificial Sequence
  siRNA antisense sequence
guuaaaccuaaacagcuuu

SEQ ID NO: 2743 - RNA, 19 nt, Artificial Sequence
  siRNA sense sequence
caaugaagggauuuauucu

SEQ ID NO: 2744 - RNA, 19 nt, Artificial Sequence
  siRNA antisense sequence
agaauaaaucccuucauug

SEQ ID NO: 2745 - RNA, 19 nt, Artificial Sequence
  siRNA sense sequence
uuacucuagcucaggauuc

SEQ ID NO: 2746 - RNA, 19 nt, Artificial Sequence
  siRNA antisense sequence
gaauccugagcuagaguaa

SEQ ID NO: 2747 - RNA, 19 nt, Artificial Sequence
  siRNA sense sequence
uacucuagcucaggauucg

SEQ ID NO: 2748 - RNA, 19 nt, Artificial Sequence
  siRNA antisense sequence
cgaauccugagcuagagua

SEQ ID NO: 2749 - RNA, 19 nt, Artificial Sequence
  siRNA sense sequence
acucuagcucaggauucgu

SEQ ID NO: 2750 - RNA, 19 nt, Artificial Sequence
  siRNA antisense sequence
acgaauccugagcuagagu

SEQ ID NO: 2751 - RNA, 19 nt, Artificial Sequence
  siRNA sense sequence
cucuagcucaggauucgua

SEQ ID NO: 2752 - RNA, 19 nt, Artificial Sequence
  siRNA antisense sequence
uacgaauccugagcuagag

SEQ ID NO: 2753 - RNA, 19 nt, Artificial Sequence
  siRNA sense sequence
ucuagcucaggauucguau

SEQ ID NO: 2754 - RNA, 19 nt, Artificial Sequence
  siRNA antisense sequence
auacgaauccugagcuaga

SEQ ID NO: 2755 - RNA, 19 nt, Artificial Sequence
  siRNA sense sequence
cuagcucaggauucguauu

SEQ ID NO: 2756 - RNA, 19 nt, Artificial Sequence
  siRNA antisense sequence
aauacgaauccugagcuag

SEQ ID NO: 2757 - RNA, 19 nt, Artificial Sequence
  siRNA sense sequence
uagcucaggauucguauuu

SEQ ID NO: 2758 - RNA, 19 nt, Artificial Sequence
  siRNA antisense sequence
aaauacgaauccugagcua

SEQ ID NO: 2759 - RNA, 19 nt, Artificial Sequence
  siRNA sense sequence
agcucaggauucguauuuu

SEQ ID NO: 2760 - RNA, 19 nt, Artificial Sequence
  siRNA antisense sequence
aaaauacgaauccugagcu

SEQ ID NO: 2761 - RNA, 19 nt, Artificial Sequence
  siRNA sense sequence
aacuaaccucaucaaagau

SEQ ID NO: 2762 - RNA, 19 nt, Artificial Sequence
  siRNA antisense sequence
aucuuugaugagguuaguu

SEQ ID NO: 2763 - RNA, 19 nt, Artificial Sequence
  siRNA sense sequence
acuaaccucaucaaagaua

SEQ ID NO: 2764 - RNA, 19 nt, Artificial Sequence
  siRNA antisense sequence
uaucuuugaugagguuagu

SEQ ID NO: 2765 - RNA, 19 nt, Artificial Sequence
  siRNA sense sequence
cuaaccucaucaaagauac

SEQ ID NO: 2766 - RNA, 19 nt, Artificial Sequence
  siRNA antisense sequence
guaucuuugaugagguuag

SEQ ID NO: 2767 - RNA, 19 nt, Artificial Sequence
  siRNA sense sequence
uaaccucaucaaagauaca

SEQ ID NO: 2768 - RNA, 19 nt, Artificial Sequence
  siRNA antisense sequence
uguaucuuugaugagguua

SEQ ID NO: 2769 - RNA, 19 nt, Artificial Sequence
  siRNA sense sequence
aaccucaucaaagauacag

SEQ ID NO: 2770 - RNA, 19 nt, Artificial Sequence
  siRNA antisense sequence
cuguaucuuugaugagguu

SEQ ID NO: 2771 - RNA, 19 nt, Artificial Sequence
  siRNA sense sequence
accucaucaaagauacaga

SEQ ID NO: 2772 - RNA, 19 nt, Artificial Sequence
  siRNA antisense sequence
ucuguaucuuugaugaggu

SEQ ID NO: 2773 - RNA, 19 nt, Artificial Sequence
  siRNA sense sequence
ccucaucaaagauacagaa

SEQ ID NO: 2774 - RNA, 19 nt, Artificial Sequence
  siRNA antisense sequence
uucuguaucuuugaugagg

SEQ ID NO: 2775 - RNA, 19 nt, Artificial Sequence
  siRNA sense sequence
aaauauagugagcccuaaa

SEQ ID NO: 2776 - RNA, 19 nt, Artificial Sequence
  siRNA antisense sequence
uuuagggcucacuauauuu

SEQ ID NO: 2777 - RNA, 19 nt, Artificial Sequence
  siRNA sense sequence
aauauagugagcccuaaag

SEQ ID NO: 2778 - RNA, 19 nt, Artificial Sequence
  siRNA antisense sequence
cuuuagggcucacuauauu

SEQ ID NO: 2779 - RNA, 19 nt, Artificial Sequence
  siRNA sense sequence
auauagugagcccuaaagg

SEQ ID NO: 2780 - RNA, 19 nt, Artificial Sequence
  siRNA antisense sequence
ccuuuagggcucacuauau

SEQ ID NO: 2781 - RNA, 19 nt, Artificial Sequence
  siRNA sense sequence
uagugagcccuaaaggaca

SEQ ID NO: 2782 - RNA, 19 nt, Artificial Sequence
  siRNA antisense sequence
uguccuuuagggcucacua

SEQ ID NO: 2783 - RNA, 19 nt, Artificial Sequence
  siRNA sense sequence
agugagcccuaaaggacac

SEQ ID NO: 2784 - RNA, 19 nt, Artificial Sequence
  siRNA antisense sequence
guguccuuuagggcucacu

SEQ ID NO: 2785 - RNA, 19 nt, Artificial Sequence
  siRNA sense sequence
acaugugguuaucuuuaga

SEQ ID NO: 2786 - RNA, 19 nt, Artificial Sequence
  siRNA antisense sequence
ucuaaagauaaccacaugu

SEQ ID NO: 2787 - RNA, 19 nt, Artificial Sequence
  siRNA sense sequence
caugugguuaucuuuagau

SEQ ID NO: 2788 - RNA, 19 nt, Artificial Sequence
  siRNA antisense sequence
aucuaaagauaaccacaug

SEQ ID NO: 2789 - RNA, 19 nt, Artificial Sequence
  siRNA sense sequence
augugguuaucuuuagauc

SEQ ID NO: 2790 - RNA, 19 nt, Artificial Sequence
  siRNA antisense sequence
gaucuaaagauaaccacau

SEQ ID NO: 2791 - RNA, 19 nt, Artificial Sequence
  siRNA sense sequence
ugugguuaucuuuagaucc

SEQ ID NO: 2792 - RNA, 19 nt, Artificial Sequence
  siRNA antisense sequence
ggaucuaaagauaaccaca

SEQ ID NO: 2793 - RNA, 19 nt, Artificial Sequence
  siRNA sense sequence
gugguuaucuuuagaucca

SEQ ID NO: 2794 - RNA, 19 nt, Artificial Sequence
  siRNA antisense sequence
uggaucuaaagauaaccac

SEQ ID NO: 2795 - RNA, 19 nt, Artificial Sequence
  siRNA sense sequence
ugguuaucuuuagauccac

SEQ ID NO: 2796 - RNA, 19 nt, Artificial Sequence
  siRNA antisense sequence
guggaucuaaagauaacca

SEQ ID NO: 2797 - RNA, 19 nt, Artificial Sequence
  siRNA sense sequence
gguuaucuuuagauccaca

SEQ ID NO: 2798 - RNA, 19 nt, Artificial Sequence
  siRNA antisense sequence
uguggaucuaaagauaacc

SEQ ID NO: 2799 - RNA, 19 nt, Artificial Sequence
  siRNA sense sequence
gauccacaucuuagcuguc

SEQ ID NO: 2800 - RNA, 19 nt, Artificial Sequence
  siRNA antisense sequence
gacagcuaagauguggauc

SEQ ID NO: 2801 - RNA, 19 nt, Artificial Sequence
  siRNA sense sequence
auccacaucuuagcuguca

SEQ ID NO: 2802 - RNA, 19 nt, Artificial Sequence
  siRNA antisense sequence
ugacagcuaagauguggau

SEQ ID NO: 2803 - RNA, 19 nt, Artificial Sequence
  siRNA sense sequence
acaucuuagcugucauuug

SEQ ID NO: 2804 - RNA, 19 nt, Artificial Sequence
  siRNA antisense sequence
caaaugacagcuaagaugu

SEQ ID NO: 2805 - RNA, 19 nt, Artificial Sequence
  siRNA sense sequence
caucuuagcugucauuugu

SEQ ID NO: 2806 - RNA, 19 nt, Artificial Sequence
  siRNA antisense sequence
acaaaugacagcuaagaug

SEQ ID NO: 2807 - RNA, 19 nt, Artificial Sequence
  siRNA sense sequence
uuagcugucauuuguucac

SEQ ID NO: 2808 - RNA, 19 nt, Artificial Sequence
  siRNA antisense sequence
gugaacaaaugacagcuaa

SEQ ID NO: 2809 - RNA, 19 nt, Artificial Sequence
  siRNA sense sequence
gcugucauuuguucacucu

SEQ ID NO: 2810 - RNA, 19 nt, Artificial Sequence
  siRNA antisense sequence
agagugaacaaaugacagc

SEQ ID NO: 2811 - RNA, 19 nt, Artificial Sequence
  siRNA sense sequence
cugucauuuguucacucua

SEQ ID NO: 2812 - RNA, 19 nt, Artificial Sequence
  siRNA antisense sequence
uagagugaacaaaugacag

SEQ ID NO: 2813 - RNA, 19 nt, Artificial Sequence
  siRNA sense sequence
ugucauuuguucacucuaa

SEQ ID NO: 2814 - RNA, 19 nt, Artificial Sequence
  siRNA antisense sequence
uuagagugaacaaaugaca

SEQ ID NO: 2815 - RNA, 19 nt, Artificial Sequence
  siRNA sense sequence
gucauuuguucacucuaaa

SEQ ID NO: 2816 - RNA, 19 nt, Artificial Sequence
  siRNA antisense sequence
uuuagagugaacaaaugac

SEQ ID NO: 2817 - RNA, 19 nt, Artificial Sequence
  siRNA sense sequence
aacugauguucaucuuucu

SEQ ID NO: 2818 - RNA, 19 nt, Artificial Sequence
  siRNA antisense sequence
agaaagaugaacaucaguu

SEQ ID NO: 2819 - RNA, 19 nt, Artificial Sequence
  siRNA sense sequence
acugauguucaucuuucug

SEQ ID NO: 2820 - RNA, 19 nt, Artificial Sequence
  siRNA antisense sequence
cagaaagaugaacaucagu

SEQ ID NO: 2821 - RNA, 19 nt, Artificial Sequence
  siRNA sense sequence
cugauguucaucuuucugu

SEQ ID NO: 2822 - RNA, 19 nt, Artificial Sequence
  siRNA antisense sequence
acagaaagaugaacaucag

SEQ ID NO: 2823 - RNA, 19 nt, Artificial Sequence
  siRNA sense sequence
gauguucaucuuucuguua

SEQ ID NO: 2824 - RNA, 19 nt, Artificial Sequence
  siRNA antisense sequence
uaacagaaagaugaacauc

SEQ ID NO: 2825 - RNA, 19 nt, Artificial Sequence
  siRNA sense sequence
caucuuucuguuaauuucc

SEQ ID NO: 2826 - RNA, 19 nt, Artificial Sequence
  siRNA antisense sequence
ggaaauuaacagaaagaug

SEQ ID NO: 2827 - RNA, 19 nt, Artificial Sequence
  siRNA sense sequence
guuaauuucccucugccua

SEQ ID NO: 2828 - RNA, 19 nt, Artificial Sequence
  siRNA antisense sequence
uaggcagagggaaauuaac

SEQ ID NO: 2829 - RNA, 19 nt, Artificial Sequence
  siRNA sense sequence
uuaauuucccucugccuaa

SEQ ID NO: 2830 - RNA, 19 nt, Artificial Sequence
  siRNA antisense sequence
uuaggcagagggaaauuaa

SEQ ID NO: 2831 - RNA, 19 nt, Artificial Sequence
  siRNA sense sequence
aauuucccucugccuaaag

SEQ ID NO: 2832 - RNA, 19 nt, Artificial Sequence
  siRNA antisense sequence
cuuuaggcagagggaaauu

SEQ ID NO: 2833 - RNA, 19 nt, Artificial Sequence
  siRNA sense sequence
auuucccucugccuaaaga

SEQ ID NO: 2834 - RNA, 19 nt, Artificial Sequence
  siRNA antisense sequence
ucuuuaggcagagggaaau

SEQ ID NO: 2835 - RNA, 19 nt, Artificial Sequence
  siRNA sense sequence
uuucccucugccuaaagac

SEQ ID NO: 2836 - RNA, 19 nt, Artificial Sequence
  siRNA antisense sequence
gucuuuaggcagagggaaa

SEQ ID NO: 2837 - RNA, 19 nt, Artificial Sequence
  siRNA sense sequence
uucccucugccuaaagacu

SEQ ID NO: 2838 - RNA, 19 nt, Artificial Sequence
  siRNA antisense sequence
agucuuuaggcagagggaa

SEQ ID NO: 2839 - RNA, 19 nt, Artificial Sequence
  siRNA sense sequence
ucccucugccuaaagacua

SEQ ID NO: 2840 - RNA, 19 nt, Artificial Sequence
  siRNA antisense sequence
uagucuuuaggcagaggga

SEQ ID NO: 2841 - RNA, 19 nt, Artificial Sequence
  siRNA sense sequence
cccucugccuaaagacuac

SEQ ID NO: 2842 - RNA, 19 nt, Artificial Sequence
  siRNA antisense sequence
guagucuuuaggcagaggg

SEQ ID NO: 2843 - RNA, 19 nt, Artificial Sequence
  siRNA sense sequence
ccucugccuaaagacuaca

SEQ ID NO: 2844 - RNA, 19 nt, Artificial Sequence
  siRNA antisense sequence
uguagucuuuaggcagagg

SEQ ID NO: 2845 - RNA, 19 nt, Artificial Sequence
  siRNA sense sequence
ugccuaaagacuacaugac

SEQ ID NO: 2846 - RNA, 19 nt, Artificial Sequence
  siRNA antisense sequence
gucauguagucuuuaggca

SEQ ID NO: 2847 - RNA, 19 nt, Artificial Sequence
  siRNA sense sequence
gccuaaagacuacaugaca

SEQ ID NO: 2848 - RNA, 19 nt, Artificial Sequence
  siRNA antisense sequence
ugucauguagucuuuaggc

SEQ ID NO: 2849 - RNA, 19 nt, Artificial Sequence
  siRNA sense sequence
ccuaaagacuacaugacag

SEQ ID NO: 2850 - RNA, 19 nt, Artificial Sequence
  siRNA antisense sequence
cugucauguagucuuuagg

SEQ ID NO: 2851 - RNA, 19 nt, Artificial Sequence
  siRNA sense sequence
cuaaagacuacaugacaga

SEQ ID NO: 2852 - RNA, 19 nt, Artificial Sequence
  siRNA antisense sequence
ucugucauguagucuuuag

SEQ ID NO: 2853 - RNA, 19 nt, Artificial Sequence
  siRNA sense sequence
uaaagacuacaugacagaa

SEQ ID NO: 2854 - RNA, 19 nt, Artificial Sequence
  siRNA antisense sequence
uucugucauguagucuuua

SEQ ID NO: 2855 - RNA, 19 nt, Artificial Sequence
  siRNA sense sequence
aaugaccuaucacuacuua

SEQ ID NO: 2856 - RNA, 19 nt, Artificial Sequence
  siRNA antisense sequence
uaaguagugauaggucauu

SEQ ID NO: 2857 - RNA, 19 nt, Artificial Sequence
  siRNA sense sequence
augaccuaucacuacuuau

SEQ ID NO: 2858 - RNA, 19 nt, Artificial Sequence
  siRNA antisense sequence
auaaguagugauaggucau

SEQ ID NO: 2859 - RNA, 19 nt, Artificial Sequence
  siRNA sense sequence
ugaccuaucacuacuuauu

SEQ ID NO: 2860 - RNA, 19 nt, Artificial Sequence
  siRNA antisense sequence
aauaaguagugauagguca

SEQ ID NO: 2861 - RNA, 19 nt, Artificial Sequence
  siRNA sense sequence
gaccuaucacuacuuauua

SEQ ID NO: 2862 - RNA, 19 nt, Artificial Sequence
  siRNA antisense sequence
uaauaaguagugauagguc

SEQ ID NO: 2863 - RNA, 19 nt, Artificial Sequence
  siRNA sense sequence
cuuauuauuucugaagccu

SEQ ID NO: 2864 - RNA, 19 nt, Artificial Sequence
  siRNA antisense sequence
aggcuucagaaauaauaag

SEQ ID NO: 2865 - RNA, 19 nt, Artificial Sequence
  siRNA sense sequence
auuauuucugaagccuaac

SEQ ID NO: 2866 - RNA, 19 nt, Artificial Sequence
  siRNA antisense sequence
guuaggcuucagaaauaau

SEQ ID NO: 2867 - RNA, 19 nt, Artificial Sequence
  siRNA sense sequence
uuauuucugaagccuaacu

SEQ ID NO: 2868 - RNA, 19 nt, Artificial Sequence
  siRNA antisense sequence
aguuaggcuucagaaauaa

SEQ ID NO: 2869 - RNA, 19 nt, Artificial Sequence
  siRNA sense sequence
ucugaagccuaacugcaag

SEQ ID NO: 2870 - RNA, 19 nt, Artificial Sequence
  siRNA antisense sequence
cuugcaguuaggcuucaga

SEQ ID NO: 2871 - RNA, 19 nt, Artificial Sequence
  siRNA sense sequence
cugaagccuaacugcaaga

SEQ ID NO: 2872 - RNA, 19 nt, Artificial Sequence
  siRNA antisense sequence
ucuugcaguuaggcuucag

SEQ ID NO: 2873 - RNA, 19 nt, Artificial Sequence
  siRNA sense sequence
ccuaacugcaagacugauu

SEQ ID NO: 2874 - RNA, 19 nt, Artificial Sequence
  siRNA antisense sequence
aaucagucuugcaguuagg

SEQ ID NO: 2875 - RNA, 19 nt, Artificial Sequence
  siRNA sense sequence
acugcaagacugauuucug

SEQ ID NO: 2876 - RNA, 19 nt, Artificial Sequence
  siRNA antisense sequence
cagaaaucagucuugcagu

SEQ ID NO: 2877 - RNA, 19 nt, Artificial Sequence
  siRNA sense sequence
cugcaagacugauuucuga

SEQ ID NO: 2878 - RNA, 19 nt, Artificial Sequence
  siRNA antisense sequence
ucagaaaucagucuugcag

SEQ ID NO: 2879 - RNA, 19 nt, Artificial Sequence
  siRNA sense sequence
ugcaagacugauuucugag

SEQ ID NO: 2880 - RNA, 19 nt, Artificial Sequence
  siRNA antisense sequence
cucagaaaucagucuugca

SEQ ID NO: 2881 - RNA, 19 nt, Artificial Sequence
  siRNA sense sequence
aacuugcuaguguguggau

SEQ ID NO: 2882 - RNA, 19 nt, Artificial Sequence
  siRNA antisense sequence
auccacacacuagcaaguu

SEQ ID NO: 2883 - RNA, 19 nt, Artificial Sequence
  siRNA sense sequence
acuugcuaguguguggaua

SEQ ID NO: 2884 - RNA, 19 nt, Artificial Sequence
  siRNA antisense sequence
uauccacacacuagcaagu

SEQ ID NO: 2885 - RNA, 19 nt, Artificial Sequence
  siRNA sense sequence
cuugcuaguguguggauau

SEQ ID NO: 2886 - RNA, 19 nt, Artificial Sequence
  siRNA antisense sequence
auauccacacacuagcaag

SEQ ID NO: 2887 - RNA, 19 nt, Artificial Sequence
  siRNA sense sequence
uugcuaguguguggauaug

SEQ ID NO: 2888 - RNA, 19 nt, Artificial Sequence
  siRNA antisense sequence
cauauccacacacuagcaa

SEQ ID NO: 2889 - RNA, 19 nt, Artificial Sequence
  siRNA sense sequence
ugcuaguguguggauaugu

SEQ ID NO: 2890 - RNA, 19 nt, Artificial Sequence
  siRNA antisense sequence
acauauccacacacuagca

SEQ ID NO: 2891 - RNA, 19 nt, Artificial Sequence
  siRNA sense sequence
gcuaguguguggauaugua

SEQ ID NO: 2892 - RNA, 19 nt, Artificial Sequence
  siRNA antisense sequence
uacauauccacacacuagc

SEQ ID NO: 2893 - RNA, 19 nt, Artificial Sequence
  siRNA sense sequence
uaguguguggauauguacc

SEQ ID NO: 2894 - RNA, 19 nt, Artificial Sequence
  siRNA antisense sequence
gguacauauccacacacua

SEQ ID NO: 2895 - RNA, 19 nt, Artificial Sequence
  siRNA sense sequence
aguguguggauauguaccc

SEQ ID NO: 2896 - RNA, 19 nt, Artificial Sequence
  siRNA antisense sequence
ggguacauauccacacacu

SEQ ID NO: 2897 - RNA, 19 nt, Artificial Sequence
  siRNA sense sequence
guguguggauauguacccu

SEQ ID NO: 2898 - RNA, 19 nt, Artificial Sequence
  siRNA antisense sequence
aggguacauauccacacac

SEQ ID NO: 2899 - RNA, 19 nt, Artificial Sequence
  siRNA sense sequence
uguguggauauguacccua

SEQ ID NO: 2900 - RNA, 19 nt, Artificial Sequence
  siRNA antisense sequence
uaggguacauauccacaca

SEQ ID NO: 2901 - RNA, 19 nt, Artificial Sequence
  siRNA sense sequence
guguggauauguacccuac

SEQ ID NO: 2902 - RNA, 19 nt, Artificial Sequence
  siRNA antisense sequence
guaggguacauauccacac

SEQ ID NO: 2903 - RNA, 19 nt, Artificial Sequence
  siRNA sense sequence
uguggauauguacccuacu

SEQ ID NO: 2904 - RNA, 19 nt, Artificial Sequence
  siRNA antisense sequence
aguaggguacauauccaca

SEQ ID NO: 2905 - RNA, 19 nt, Artificial Sequence
  siRNA sense sequence
guggauauguacccuacuu

SEQ ID NO: 2906 - RNA, 19 nt, Artificial Sequence
  siRNA antisense sequence
aaguaggguacauauccac

SEQ ID NO: 2907 - RNA, 19 nt, Artificial Sequence
  siRNA sense sequence
uggauauguacccuacuug

SEQ ID NO: 2908 - RNA, 19 nt, Artificial Sequence
  siRNA antisense sequence
caaguaggguacauaucca

SEQ ID NO: 2909 - RNA, 19 nt, Artificial Sequence
  siRNA sense sequence
ggauauguacccuacuugu

SEQ ID NO: 2910 - RNA, 19 nt, Artificial Sequence
  siRNA antisense sequence
acaaguaggguacauaucc

SEQ ID NO: 2911 - RNA, 19 nt, Artificial Sequence
  siRNA sense sequence
gauauguacccuacuugug

SEQ ID NO: 2912 - RNA, 19 nt, Artificial Sequence
  siRNA antisense sequence
cacaaguaggguacauauc

SEQ ID NO: 2913 - RNA, 19 nt, Artificial Sequence
  siRNA sense sequence
uugaagauauaaagagcag

SEQ ID NO: 2914 - RNA, 19 nt, Artificial Sequence
  siRNA antisense sequence
cugcucuuuauaucuucaa

SEQ ID NO: 2915 - RNA, 19 nt, Artificial Sequence
  siRNA sense sequence
auauaaagagcagccaaaa

SEQ ID NO: 2916 - RNA, 19 nt, Artificial Sequence
  siRNA antisense sequence
uuuuggcugcucuuuauau

SEQ ID NO: 2917 - RNA, 19 nt, Artificial Sequence
  siRNA sense sequence
uauaaagagcagccaaaau

SEQ ID NO: 2918 - RNA, 19 nt, Artificial Sequence
  siRNA antisense sequence
auuuuggcugcucuuuaua

SEQ ID NO: 2919 - RNA, 19 nt, Artificial Sequence
  siRNA sense sequence
auaaagagcagccaaaaug

SEQ ID NO: 2920 - RNA, 19 nt, Artificial Sequence
  siRNA antisense sequence
cauuuuggcugcucuuuau

SEQ ID NO: 2921 - RNA, 19 nt, Artificial Sequence
  siRNA sense sequence
ccaaaaugauggcaaaaug

SEQ ID NO: 2922 - RNA, 19 nt, Artificial Sequence
  siRNA antisense sequence
cauuuugccaucauuuugg

SEQ ID NO: 2923 - RNA, 19 nt, Artificial Sequence
  siRNA sense sequence
augauggcaaaaugguagg

SEQ ID NO: 2924 - RNA, 19 nt, Artificial Sequence
  siRNA antisense sequence
ccuaccauuuugccaucau

SEQ ID NO: 2925 - RNA, 19 nt, Artificial Sequence
  siRNA sense sequence
ugauggcaaaaugguaggc

SEQ ID NO: 2926 - RNA, 19 nt, Artificial Sequence
  siRNA antisense sequence
gccuaccauuuugccauca

SEQ ID NO: 2927 - RNA, 19 nt, Artificial Sequence
  siRNA sense sequence
gauggcaaaaugguaggcu

SEQ ID NO: 2928 - RNA, 19 nt, Artificial Sequence
  siRNA antisense sequence
agccuaccauuuugccauc

SEQ ID NO: 2929 - RNA, 19 nt, Artificial Sequence
  siRNA sense sequence
auggcaaaaugguaggcua

SEQ ID NO: 2930 - RNA, 19 nt, Artificial Sequence
  siRNA antisense sequence
uagccuaccauuuugccau

SEQ ID NO: 2931 - RNA, 19 nt, Artificial Sequence
  siRNA sense sequence
uggcaaaaugguaggcuaa

SEQ ID NO: 2932 - RNA, 19 nt, Artificial Sequence
  siRNA antisense sequence
uuagccuaccauuuugcca

SEQ ID NO: 2933 - RNA, 19 nt, Artificial Sequence
  siRNA sense sequence
ggcaaaaugguaggcuaau

SEQ ID NO: 2934 - RNA, 19 nt, Artificial Sequence
  siRNA antisense sequence
auuagccuaccauuuugcc

SEQ ID NO: 2935 - RNA, 19 nt, Artificial Sequence
  siRNA sense sequence
gcaaaaugguaggcuaaua

SEQ ID NO: 2936 - RNA, 19 nt, Artificial Sequence
  siRNA antisense sequence
uauuagccuaccauuuugc

SEQ ID NO: 2937 - RNA, 19 nt, Artificial Sequence
  siRNA sense sequence
caaaaugguaggcuaauau

SEQ ID NO: 2938 - RNA, 19 nt, Artificial Sequence
  siRNA antisense sequence
auauuagccuaccauuuug

SEQ ID NO: 2939 - RNA, 19 nt, Artificial Sequence
  siRNA sense sequence
augguaggcuaauauuuuc

SEQ ID NO: 2940 - RNA, 19 nt, Artificial Sequence
  siRNA antisense sequence
gaaaauauuagccuaccau

SEQ ID NO: 2941 - RNA, 19 nt, Artificial Sequence
  siRNA sense sequence
ugguaggcuaauauuuucu

SEQ ID NO: 2942 - RNA, 19 nt, Artificial Sequence
  siRNA antisense sequence
agaaaauauuagccuacca

SEQ ID NO: 2943 - RNA, 19 nt, Artificial Sequence
  siRNA sense sequence
gguaggcuaauauuuucua

SEQ ID NO: 2944 - RNA, 19 nt, Artificial Sequence
  siRNA antisense sequence
uagaaaauauuagccuacc

SEQ ID NO: 2945 - RNA, 19 nt, Artificial Sequence
  siRNA sense sequence
ucauauuuuggaaucaugc

SEQ ID NO: 2946 - RNA, 19 nt, Artificial Sequence
  siRNA antisense sequence
gcaugauuccaaaauauga

SEQ ID NO: 2947 - RNA, 19 nt, Artificial Sequence
  siRNA sense sequence
cauauuuuggaaucaugca

SEQ ID NO: 2948 - RNA, 19 nt, Artificial Sequence
  siRNA antisense sequence
ugcaugauuccaaaauaug

SEQ ID NO: 2949 - RNA, 19 nt, Artificial Sequence
  siRNA sense sequence
uuggaaucaugcaauuuug

SEQ ID NO: 2950 - RNA, 19 nt, Artificial Sequence
  siRNA antisense sequence
caaaauugcaugauuccaa

SEQ ID NO: 2951 - RNA, 19 nt, Artificial Sequence
  siRNA sense sequence
gguauuggcaugcaguuuc

SEQ ID NO: 2952 - RNA, 19 nt, Artificial Sequence
  siRNA antisense sequence
gaaacugcaugccaauacc

SEQ ID NO: 2953 - RNA, 19 nt, Artificial Sequence
  siRNA sense sequence
guauuggcaugcaguuucu

SEQ ID NO: 2954 - RNA, 19 nt, Artificial Sequence
  siRNA antisense sequence
agaaacugcaugccaauac

SEQ ID NO: 2955 - RNA, 19 nt, Artificial Sequence
  siRNA sense sequence
auuggcaugcaguuucuua

SEQ ID NO: 2956 - RNA, 19 nt, Artificial Sequence
  siRNA antisense sequence
uaagaaacugcaugccaau

SEQ ID NO: 2957 - RNA, 19 nt, Artificial Sequence
  siRNA sense sequence
uuggcaugcaguuucuuac

SEQ ID NO: 2958 - RNA, 19 nt, Artificial Sequence
  siRNA antisense sequence
guaagaaacugcaugccaa

SEQ ID NO: 2959 - RNA, 19 nt, Artificial Sequence
  siRNA sense sequence
uggcaugcaguuucuuacu

SEQ ID NO: 2960 - RNA, 19 nt, Artificial Sequence
  siRNA antisense sequence
aguaagaaacugcaugcca

SEQ ID NO: 2961 - RNA, 19 nt, Artificial Sequence
  siRNA sense sequence
ggcaugcaguuucuuacuu

SEQ ID NO: 2962 - RNA, 19 nt, Artificial Sequence
  siRNA antisense sequence
aaguaagaaacugcaugcc

SEQ ID NO: 2963 - RNA, 19 nt, Artificial Sequence
  siRNA sense sequence
gcaugcaguuucuuacuua

SEQ ID NO: 2964 - RNA, 19 nt, Artificial Sequence
  siRNA antisense sequence
uaaguaagaaacugcaugc

SEQ ID NO: 2965 - RNA, 19 nt, Artificial Sequence
  siRNA sense sequence
caugcaguuucuuacuuau

SEQ ID NO: 2966 - RNA, 19 nt, Artificial Sequence
  siRNA antisense sequence
auaaguaagaaacugcaug

SEQ ID NO: 2967 - RNA, 19 nt, Artificial Sequence
  siRNA sense sequence
augcaguuucuuacuuauc

SEQ ID NO: 2968 - RNA, 19 nt, Artificial Sequence
  siRNA antisense sequence
gauaaguaagaaacugcau

SEQ ID NO: 2969 - RNA, 19 nt, Artificial Sequence
  siRNA sense sequence
ugcaguuucuuacuuaucu

SEQ ID NO: 2970 - RNA, 19 nt, Artificial Sequence
  siRNA antisense sequence
agauaaguaagaaacugca

SEQ ID NO: 2971 - RNA, 19 nt, Artificial Sequence
  siRNA sense sequence
gcaguuucuuacuuaucua

SEQ ID NO: 2972 - RNA, 19 nt, Artificial Sequence
  siRNA antisense sequence
uagauaaguaagaaacugc

SEQ ID NO: 2973 - RNA, 19 nt, Artificial Sequence
  siRNA sense sequence
caguuucuuacuuaucuag

SEQ ID NO: 2974 - RNA, 19 nt, Artificial Sequence
  siRNA antisense sequence
cuagauaaguaagaaacug

SEQ ID NO: 2975 - RNA, 19 nt, Artificial Sequence
  siRNA sense sequence
cuuaucuagaauauuuggc

SEQ ID NO: 2976 - RNA, 19 nt, Artificial Sequence
  siRNA antisense sequence
gccaaauauucuagauaag

SEQ ID NO: 2977 - RNA, 19 nt, Artificial Sequence
  siRNA sense sequence
cuagaauauuuggcuuauc

SEQ ID NO: 2978 - RNA, 19 nt, Artificial Sequence
  siRNA antisense sequence
gauaagccaaauauucuag

SEQ ID NO: 2979 - RNA, 19 nt, Artificial Sequence
  siRNA sense sequence
agaauauuuggcuuaucug

SEQ ID NO: 2980 - RNA, 19 nt, Artificial Sequence
  siRNA antisense sequence
cagauaagccaaauauucu

SEQ ID NO: 2981 - RNA, 19 nt, Artificial Sequence
  siRNA sense sequence
gaauauuuggcuuaucuga

SEQ ID NO: 2982 - RNA, 19 nt, Artificial Sequence
  siRNA antisense sequence
ucagauaagccaaauauuc

SEQ ID NO: 2983 - RNA, 19 nt, Artificial Sequence
  siRNA sense sequence
ucaauuuaagaucucugga

SEQ ID NO: 2984 - RNA, 19 nt, Artificial Sequence
  siRNA antisense sequence
uccagagaucuuaaauuga

SEQ ID NO: 2985 - RNA, 19 nt, Artificial Sequence
  siRNA sense sequence
caauuuaagaucucuggaa

SEQ ID NO: 2986 - RNA, 19 nt, Artificial Sequence
  siRNA antisense sequence
uuccagagaucuuaaauug

SEQ ID NO: 2987 - RNA, 19 nt, Artificial Sequence
  siRNA sense sequence
auuuaagaucucuggaagu

SEQ ID NO: 2988 - RNA, 19 nt, Artificial Sequence
  siRNA antisense sequence
acuuccagagaucuuaaau

SEQ ID NO: 2989 - RNA, 19 nt, Artificial Sequence
  siRNA sense sequence
uuuaagaucucuggaagug

SEQ ID NO: 2990 - RNA, 19 nt, Artificial Sequence
  siRNA antisense sequence
cacuuccagagaucuuaaa

SEQ ID NO: 2991 - RNA, 19 nt, Artificial Sequence
  siRNA sense sequence
gaucucuggaaguguuaga

SEQ ID NO: 2992 - RNA, 19 nt, Artificial Sequence
  siRNA antisense sequence
ucuaacacuuccagagauc

SEQ ID NO: 2993 - RNA, 19 nt, Artificial Sequence
  siRNA sense sequence
uuuugauccuucacagugu

SEQ ID NO: 2994 - RNA, 19 nt, Artificial Sequence
  siRNA antisense sequence
acacugugaaggaucaaaa

SEQ ID NO: 2995 - RNA, 19 nt, Artificial Sequence
  siRNA sense sequence
uuugauccuucacaguguc

SEQ ID NO: 2996 - RNA, 19 nt, Artificial Sequence
  siRNA antisense sequence
gacacugugaaggaucaaa

SEQ ID NO: 2997 - RNA, 19 nt, Artificial Sequence
  siRNA sense sequence
uugauccuucacaguguca

SEQ ID NO: 2998 - RNA, 19 nt, Artificial Sequence
  siRNA antisense sequence
ugacacugugaaggaucaa

SEQ ID NO: 2999 - RNA, 19 nt, Artificial Sequence
  siRNA sense sequence
ugauccuucacagugucaa

SEQ ID NO: 3000 - RNA, 19 nt, Artificial Sequence
  siRNA antisense sequence
uugacacugugaaggauca

SEQ ID NO: 3001 - RNA, 19 nt, Artificial Sequence
  siRNA sense sequence
gauccuucacagugucaau

SEQ ID NO: 3002 - RNA, 19 nt, Artificial Sequence
  siRNA antisense sequence
auugacacugugaaggauc

SEQ ID NO: 3003 - RNA, 19 nt, Artificial Sequence
  siRNA sense sequence
auccuucacagugucaaua

SEQ ID NO: 3004 - RNA, 19 nt, Artificial Sequence
  siRNA antisense sequence
uauugacacugugaaggau

SEQ ID NO: 3005 - RNA, 19 nt, Artificial Sequence
  siRNA sense sequence
uccuucacagugucaauau

SEQ ID NO: 3006 - RNA, 19 nt, Artificial Sequence
  siRNA antisense sequence
auauugacacugugaagga

SEQ ID NO: 3007 - RNA, 19 nt, Artificial Sequence
  siRNA sense sequence
ccuucacagugucaauauu

SEQ ID NO: 3008 - RNA, 19 nt, Artificial Sequence
  siRNA antisense sequence
aauauugacacugugaagg

SEQ ID NO: 3009 - RNA, 19 nt, Artificial Sequence
  siRNA sense sequence
cuucacagugucaauauuu

SEQ ID NO: 3010 - RNA, 19 nt, Artificial Sequence
  siRNA antisense sequence
aaauauugacacugugaag

SEQ ID NO: 3011 - RNA, 19 nt, Artificial Sequence
  siRNA sense sequence
gcuuuauuuauuagacgug

SEQ ID NO: 3012 - RNA, 19 nt, Artificial Sequence
  siRNA antisense sequence
cacgucuaauaaauaaagc

SEQ ID NO: 3013 - RNA, 19 nt, Artificial Sequence
  siRNA sense sequence
uuauuagacguguugagug

SEQ ID NO: 3014 - RNA, 19 nt, Artificial Sequence
  siRNA antisense sequence
cacucaacacgucuaauaa

SEQ ID NO: 3015 - RNA, 19 nt, Artificial Sequence
  siRNA sense sequence
uauuagacguguugaguga

SEQ ID NO: 3016 - RNA, 19 nt, Artificial Sequence
  siRNA antisense sequence
ucacucaacacgucuaaua

SEQ ID NO: 3017 - RNA, 19 nt, Artificial Sequence
  siRNA sense sequence
auuagacguguugagugag

SEQ ID NO: 3018 - RNA, 19 nt, Artificial Sequence
  siRNA antisense sequence
cucacucaacacgucuaau

SEQ ID NO: 3019 - RNA, 19 nt, Artificial Sequence
  siRNA sense sequence
gacguguugagugagugcu

SEQ ID NO: 3020 - RNA, 19 nt, Artificial Sequence
  siRNA antisense sequence
agcacucacucaacacguc

SEQ ID NO: 3021 - RNA, 19 nt, Artificial Sequence
  siRNA sense sequence
ugagugagugcugaguucc

SEQ ID NO: 3022 - RNA, 19 nt, Artificial Sequence
  siRNA antisense sequence
ggaacucagcacucacuca

SEQ ID NO: 3023 - RNA, 19 nt, Artificial Sequence
  siRNA sense sequence
gagugagugcugaguuccu

SEQ ID NO: 3024 - RNA, 19 nt, Artificial Sequence
  siRNA antisense sequence
aggaacucagcacucacuc

SEQ ID NO: 3025 - RNA, 19 nt, Artificial Sequence
  siRNA sense sequence
agugagugcugaguuccuu

SEQ ID NO: 3026 - RNA, 19 nt, Artificial Sequence
  siRNA antisense sequence
aaggaacucagcacucacu

SEQ ID NO: 3027 - RNA, 19 nt, Artificial Sequence
  siRNA sense sequence
gugagugcugaguuccuug

SEQ ID NO: 3028 - RNA, 19 nt, Artificial Sequence
  siRNA antisense sequence
caaggaacucagcacucac

SEQ ID NO: 3029 - RNA, 19 nt, Artificial Sequence
  siRNA sense sequence
cugaguuccuugcugccac

SEQ ID NO: 3030 - RNA, 19 nt, Artificial Sequence
  siRNA antisense sequence
guggcagcaaggaacucag

SEQ ID NO: 3031 - RNA, 19 nt, Artificial Sequence
  siRNA sense sequence
ugaguuccuugcugccacu

SEQ ID NO: 3032 - RNA, 19 nt, Artificial Sequence
  siRNA antisense sequence
aguggcagcaaggaacuca

SEQ ID NO: 3033 - RNA, 19 nt, Artificial Sequence
  siRNA sense sequence
gaguuccuugcugccacuu

SEQ ID NO: 3034 - RNA, 19 nt, Artificial Sequence
  siRNA antisense sequence
aaguggcagcaaggaacuc

SEQ ID NO: 3035 - RNA, 19 nt, Artificial Sequence
  siRNA sense sequence
uccuugcugccacuuuugu

SEQ ID NO: 3036 - RNA, 19 nt, Artificial Sequence
  siRNA antisense sequence
acaaaaguggcagcaagga

SEQ ID NO: 3037 - RNA, 19 nt, Artificial Sequence
  siRNA sense sequence
cugccacuuuuguuaccau

SEQ ID NO: 3038 - RNA, 19 nt, Artificial Sequence
  siRNA antisense sequence
augguaacaaaaguggcag

SEQ ID NO: 3039 - RNA, 19 nt, Artificial Sequence
  siRNA sense sequence
gccacuuuuguuaccauug

SEQ ID NO: 3040 - RNA, 19 nt, Artificial Sequence
  siRNA antisense sequence
caaugguaacaaaaguggc

SEQ ID NO: 3041 - RNA, 19 nt, Artificial Sequence
  siRNA sense sequence
ccacuuuuguuaccauugu

SEQ ID NO: 3042 - RNA, 19 nt, Artificial Sequence
  siRNA antisense sequence
acaaugguaacaaaagugg

SEQ ID NO: 3043 - RNA, 19 nt, Artificial Sequence
  siRNA sense sequence
cacuuuuguuaccauuguc

SEQ ID NO: 3044 - RNA, 19 nt, Artificial Sequence
  siRNA antisense sequence
gacaaugguaacaaaagug

SEQ ID NO: 3045 - RNA, 19 nt, Artificial Sequence
  siRNA sense sequence
acuuuuguuaccauuguca

SEQ ID NO: 3046 - RNA, 19 nt, Artificial Sequence
  siRNA antisense sequence
ugacaaugguaacaaaagu

SEQ ID NO: 3047 - RNA, 19 nt, Artificial Sequence
  siRNA sense sequence
caauauauauauccugucc

SEQ ID NO: 3048 - RNA, 19 nt, Artificial Sequence
  siRNA antisense sequence
ggacaggauauauauauug

SEQ ID NO: 3049 - RNA, 19 nt, Artificial Sequence
  siRNA sense sequence
uauccuguccuuauauuuc

SEQ ID NO: 3050 - RNA, 19 nt, Artificial Sequence
  siRNA antisense sequence
gaaauauaaggacaggaua

SEQ ID NO: 3051 - RNA, 19 nt, Artificial Sequence
  siRNA sense sequence
auccuguccuuauauuucu

SEQ ID NO: 3052 - RNA, 19 nt, Artificial Sequence
  siRNA antisense sequence
agaaauauaaggacaggau

SEQ ID NO: 3053 - RNA, 19 nt, Artificial Sequence
  siRNA sense sequence
uucucuagaguacauuuuc

SEQ ID NO: 3054 - RNA, 19 nt, Artificial Sequence
  siRNA antisense sequence
gaaaauguacucuagagaa

SEQ ID NO: 3055 - RNA, 19 nt, Artificial Sequence
  siRNA sense sequence
ucucuagaguacauuuucc

SEQ ID NO: 3056 - RNA, 19 nt, Artificial Sequence
  siRNA antisense sequence
ggaaaauguacucuagaga

SEQ ID NO: 3057 - RNA, 19 nt, Artificial Sequence
  siRNA sense sequence
cucuagaguacauuuucca

SEQ ID NO: 3058 - RNA, 19 nt, Artificial Sequence
  siRNA antisense sequence
uggaaaauguacucuagag

SEQ ID NO: 3059 - RNA, 19 nt, Artificial Sequence
  siRNA sense sequence
uagaguacauuuuccauca

SEQ ID NO: 3060 - RNA, 19 nt, Artificial Sequence
  siRNA antisense sequence
ugauggaaaauguacucua

SEQ ID NO: 3061 - RNA, 19 nt, Artificial Sequence
  siRNA sense sequence
agaguacauuuuccaucau

SEQ ID NO: 3062 - RNA, 19 nt, Artificial Sequence
  siRNA antisense sequence
augauggaaaauguacucu

SEQ ID NO: 3063 - RNA, 19 nt, Artificial Sequence
  siRNA sense sequence
gaguacauuuuccaucaug

SEQ ID NO: 3064 - RNA, 19 nt, Artificial Sequence
  siRNA antisense sequence
caugauggaaaauguacuc

SEQ ID NO: 3065 - RNA, 19 nt, Artificial Sequence
  siRNA sense sequence
uuuccaucauguuuaagug

SEQ ID NO: 3066 - RNA, 19 nt, Artificial Sequence
  siRNA antisense sequence
cacuuaaacaugauggaaa

SEQ ID NO: 3067 - RNA, 19 nt, Artificial Sequence
  siRNA sense sequence
uuccaucauguuuaagugu

SEQ ID NO: 3068 - RNA, 19 nt, Artificial Sequence
  siRNA antisense sequence
acacuuaaacaugauggaa

SEQ ID NO: 3069 - RNA, 19 nt, Artificial Sequence
  siRNA sense sequence
ccaucauguuuaaguguau

SEQ ID NO: 3070 - RNA, 19 nt, Artificial Sequence
  siRNA antisense sequence
auacacuuaaacaugaugg

SEQ ID NO: 3071 - RNA, 19 nt, Artificial Sequence
  siRNA sense sequence
uguuuaaguguauuucugc

SEQ ID NO: 3072 - RNA, 19 nt, Artificial Sequence
  siRNA antisense sequence
gcagaaauacacuuaaaca

SEQ ID NO: 3073 - RNA, 19 nt, Artificial Sequence
  siRNA sense sequence
guuuaaguguauuucugcu

SEQ ID NO: 3074 - RNA, 19 nt, Artificial Sequence
  siRNA antisense sequence
agcagaaauacacuuaaac

SEQ ID NO: 3075 - RNA, 19 nt, Artificial Sequence
  siRNA sense sequence
ucugcuauuauuuccucuc

SEQ ID NO: 3076 - RNA, 19 nt, Artificial Sequence
  siRNA antisense sequence
gagaggaaauaauagcaga

SEQ ID NO: 3077 - RNA, 19 nt, Artificial Sequence
  siRNA sense sequence
uauuauuuccucuccugca

SEQ ID NO: 3078 - RNA, 19 nt, Artificial Sequence
  siRNA antisense sequence
ugcaggagaggaaauaaua

SEQ ID NO: 3079 - RNA, 19 nt, Artificial Sequence
  siRNA sense sequence
uccucuccugcagaauaca

SEQ ID NO: 3080 - RNA, 19 nt, Artificial Sequence
  siRNA antisense sequence
uguauucugcaggagagga

SEQ ID NO: 3081 - RNA, 19 nt, Artificial Sequence
  siRNA sense sequence
ccucuccugcagaauacau

SEQ ID NO: 3082 - RNA, 19 nt, Artificial Sequence
  siRNA antisense sequence
auguauucugcaggagagg

SEQ ID NO: 3083 - RNA, 19 nt, Artificial Sequence
  siRNA sense sequence
cucuccugcagaauacaua

SEQ ID NO: 3084 - RNA, 19 nt, Artificial Sequence
  siRNA antisense sequence
uauguauucugcaggagag

SEQ ID NO: 3085 - RNA, 19 nt, Artificial Sequence
  siRNA sense sequence
ucuccugcagaauacauac

SEQ ID NO: 3086 - RNA, 19 nt, Artificial Sequence
  siRNA antisense sequence
guauguauucugcaggaga

SEQ ID NO: 3087 - RNA, 19 nt, Artificial Sequence
  siRNA sense sequence
guguauguguauaaaguca

SEQ ID NO: 3088 - RNA, 19 nt, Artificial Sequence
  siRNA antisense sequence
ugacuuuauacacauacac

SEQ ID NO: 3089 - RNA, 19 nt, Artificial Sequence
  siRNA sense sequence
ugaaucacauuuccauacu

SEQ ID NO: 3090 - RNA, 19 nt, Artificial Sequence
  siRNA antisense sequence
aguauggaaaugugauuca

SEQ ID NO: 3091 - RNA, 19 nt, Artificial Sequence
  siRNA sense sequence
cacauuuccauacugucug

SEQ ID NO: 3092 - RNA, 19 nt, Artificial Sequence
  siRNA antisense sequence
cagacaguauggaaaugug

SEQ ID NO: 3093 - RNA, 19 nt, Artificial Sequence
  siRNA sense sequence
acauuuccauacugucugu

SEQ ID NO: 3094 - RNA, 19 nt, Artificial Sequence
  siRNA antisense sequence
acagacaguauggaaaugu

SEQ ID NO: 3095 - RNA, 19 nt, Artificial Sequence
  siRNA sense sequence
cauuuccauacugucuguu

SEQ ID NO: 3096 - RNA, 19 nt, Artificial Sequence
  siRNA antisense sequence
aacagacaguauggaaaug

SEQ ID NO: 3097 - RNA, 19 nt, Artificial Sequence
  siRNA sense sequence
auuuccauacugucuguua

SEQ ID NO: 3098 - RNA, 19 nt, Artificial Sequence
  siRNA antisense sequence
uaacagacaguauggaaau

SEQ ID NO: 3099 - RNA, 19 nt, Artificial Sequence
  siRNA sense sequence
uuccauacugucuguuauu

SEQ ID NO: 3100 - RNA, 19 nt, Artificial Sequence
  siRNA antisense sequence
aauaacagacaguauggaa

SEQ ID NO: 3101 - RNA, 19 nt, Artificial Sequence
  siRNA sense sequence
ccauacugucuguuauuuu

SEQ ID NO: 3102 - RNA, 19 nt, Artificial Sequence
  siRNA antisense sequence
aaaauaacagacaguaugg

SEQ ID NO: 3103 - RNA, 19 nt, Artificial Sequence
  siRNA sense sequence
uuggguuuuauauuggguu

SEQ ID NO: 3104 - RNA, 19 nt, Artificial Sequence
  siRNA antisense sequence
aacccaauauaaaacccaa

SEQ ID NO: 3105 - RNA, 19 nt, Artificial Sequence
  siRNA sense sequence
uggguuuuauauuggguuu

SEQ ID NO: 3106 - RNA, 19 nt, Artificial Sequence
  siRNA antisense sequence
aaacccaauauaaaaccca

SEQ ID NO: 3107 - RNA, 19 nt, Artificial Sequence
  siRNA sense sequence
ggguuuuauauuggguuuc

SEQ ID NO: 3108 - RNA, 19 nt, Artificial Sequence
  siRNA antisense sequence
gaaacccaauauaaaaccc

SEQ ID NO: 3109 - RNA, 19 nt, Artificial Sequence
  siRNA sense sequence
gguuuuauauuggguuucu

SEQ ID NO: 3110 - RNA, 19 nt, Artificial Sequence
  siRNA antisense sequence
agaaacccaauauaaaacc

SEQ ID NO: 3111 - RNA, 19 nt, Artificial Sequence
  siRNA sense sequence
uggguuucuuuaguuuaug

SEQ ID NO: 3112 - RNA, 19 nt, Artificial Sequence
  siRNA antisense sequence
cauaaacuaaagaaaccca

SEQ ID NO: 3113 - RNA, 19 nt, Artificial Sequence
  siRNA sense sequence
uuucucaaaagcagcauuu

SEQ ID NO: 3114 - RNA, 19 nt, Artificial Sequence
  siRNA antisense sequence
aaaugcugcuuuugagaaa

SEQ ID NO: 3115 - RNA, 19 nt, Artificial Sequence
  siRNA sense sequence
agcagcauuuuaaauuacg

SEQ ID NO: 3116 - RNA, 19 nt, Artificial Sequence
  siRNA antisense sequence
cguaauuuaaaaugcugcu

SEQ ID NO: 3117 - RNA, 19 nt, Artificial Sequence
  siRNA sense sequence
gcagcauuuuaaauuacga

SEQ ID NO: 3118 - RNA, 19 nt, Artificial Sequence
  siRNA antisense sequence
ucguaauuuaaaaugcugc

SEQ ID NO: 3119 - RNA, 19 nt, Artificial Sequence
  siRNA sense sequence
auuacgaauacuggacuua

SEQ ID NO: 3120 - RNA, 19 nt, Artificial Sequence
  siRNA antisense sequence
uaaguccaguauucguaau

SEQ ID NO: 3121 - RNA, 19 nt, Artificial Sequence
  siRNA sense sequence
uuacgaauacuggacuuau

SEQ ID NO: 3122 - RNA, 19 nt, Artificial Sequence
  siRNA antisense sequence
auaaguccaguauucguaa

SEQ ID NO: 3123 - RNA, 19 nt, Artificial Sequence
  siRNA sense sequence
auacuggacuuauuggauu

SEQ ID NO: 3124 - RNA, 19 nt, Artificial Sequence
  siRNA antisense sequence
aauccaauaaguccaguau

SEQ ID NO: 3125 - RNA, 19 nt, Artificial Sequence
  siRNA sense sequence
uacuggacuuauuggauuu

SEQ ID NO: 3126 - RNA, 19 nt, Artificial Sequence
  siRNA antisense sequence
aaauccaauaaguccagua

SEQ ID NO: 3127 - RNA, 19 nt, Artificial Sequence
  siRNA sense sequence
acuggacuuauuggauuua

SEQ ID NO: 3128 - RNA, 19 nt, Artificial Sequence
  siRNA antisense sequence
uaaauccaauaaguccagu

SEQ ID NO: 3129 - RNA, 19 nt, Artificial Sequence
  siRNA sense sequence
cuggacuuauuggauuuaa

SEQ ID NO: 3130 - RNA, 19 nt, Artificial Sequence
  siRNA antisense sequence
uuaaauccaauaaguccag

SEQ ID NO: 3131 - RNA, 19 nt, Artificial Sequence
  siRNA sense sequence
uuauuuaacccuugcuaag

SEQ ID NO: 3132 - RNA, 19 nt, Artificial Sequence
  siRNA antisense sequence
cuuagcaaggguuaaauaa

SEQ ID NO: 3133 - RNA, 19 nt, Artificial Sequence
  siRNA sense sequence
uauuuaacccuugcuaagu

SEQ ID NO: 3134 - RNA, 19 nt, Artificial Sequence
  siRNA antisense sequence
acuuagcaaggguuaaaua

SEQ ID NO: 3135 - RNA, 19 nt, Artificial Sequence
  siRNA sense sequence
auuuaacccuugcuaagua

SEQ ID NO: 3136 - RNA, 19 nt, Artificial Sequence
  siRNA antisense sequence
uacuuagcaaggguuaaau

SEQ ID NO: 3137 - RNA, 19 nt, Artificial Sequence
  siRNA sense sequence
uuuaacccuugcuaaguaa

SEQ ID NO: 3138 - RNA, 19 nt, Artificial Sequence
  siRNA antisense sequence
uuacuuagcaaggguuaaa

SEQ ID NO: 3139 - RNA, 19 nt, Artificial Sequence
  siRNA sense sequence
uuaacccuugcuaaguaau

SEQ ID NO: 3140 - RNA, 19 nt, Artificial Sequence
  siRNA antisense sequence
auuacuuagcaaggguuaa

SEQ ID NO: 3141 - RNA, 19 nt, Artificial Sequence
  siRNA sense sequence
uaacccuugcuaaguaauu

SEQ ID NO: 3142 - RNA, 19 nt, Artificial Sequence
  siRNA antisense sequence
aauuacuuagcaaggguua

SEQ ID NO: 3143 - RNA, 19 nt, Artificial Sequence
  siRNA sense sequence
aacccuugcuaaguaauug

SEQ ID NO: 3144 - RNA, 19 nt, Artificial Sequence
  siRNA antisense sequence
caauuacuuagcaaggguu

SEQ ID NO: 3145 - RNA, 19 nt, Artificial Sequence
  siRNA sense sequence
acccuugcuaaguaauuga

SEQ ID NO: 3146 - RNA, 19 nt, Artificial Sequence
  siRNA antisense sequence
ucaauuacuuagcaagggu

SEQ ID NO: 3147 - RNA, 19 nt, Artificial Sequence
  siRNA sense sequence
cccuugcuaaguaauugac

SEQ ID NO: 3148 - RNA, 19 nt, Artificial Sequence
  siRNA antisense sequence
gucaauuacuuagcaaggg

SEQ ID NO: 3149 - RNA, 19 nt, Artificial Sequence
  siRNA sense sequence
cuugcuaaguaauugacau

SEQ ID NO: 3150 - RNA, 19 nt, Artificial Sequence
  siRNA antisense sequence
augucaauuacuuagcaag

SEQ ID NO: 3151 - RNA, 19 nt, Artificial Sequence
  siRNA sense sequence
gcuaaguaauugacauaug

SEQ ID NO: 3152 - RNA, 19 nt, Artificial Sequence
  siRNA antisense sequence
cauaugucaauuacuuagc

SEQ ID NO: 3153 - RNA, 19 nt, Artificial Sequence
  siRNA sense sequence
caauaacuagccuaaagaa

SEQ ID NO: 3154 - RNA, 19 nt, Artificial Sequence
  siRNA antisense sequence
uucuuuaggcuaguuauug

SEQ ID NO: 3155 - RNA, 19 nt, Artificial Sequence
  siRNA sense sequence
aguaucucucccgagcuga

SEQ ID NO: 3156 - RNA, 19 nt, Artificial Sequence
  siRNA antisense sequence
ucagcucgggagagauacu

SEQ ID NO: 3157 - RNA, 19 nt, Artificial Sequence
  siRNA sense sequence
guaucucucccgagcugaa

SEQ ID NO: 3158 - RNA, 19 nt, Artificial Sequence
  siRNA antisense sequence
uucagcucgggagagauac

SEQ ID NO: 3159 - RNA, 19 nt, Artificial Sequence
  siRNA sense sequence
auuaaaugcacacuguacc

SEQ ID NO: 3160 - RNA, 19 nt, Artificial Sequence
  siRNA antisense sequence
gguacagugugcauuuaau

SEQ ID NO: 3161 - RNA, 19 nt, Artificial Sequence
  siRNA sense sequence
augcacacuguaccauuag

SEQ ID NO: 3162 - RNA, 19 nt, Artificial Sequence
  siRNA antisense sequence
cuaaugguacagugugcau

SEQ ID NO: 3163 - RNA, 19 nt, Artificial Sequence
  siRNA sense sequence
ugcacacuguaccauuaga

SEQ ID NO: 3164 - RNA, 19 nt, Artificial Sequence
  siRNA antisense sequence
ucuaaugguacagugugca

SEQ ID NO: 3165 - RNA, 19 nt, Artificial Sequence
  siRNA sense sequence
gcacacuguaccauuagau

SEQ ID NO: 3166 - RNA, 19 nt, Artificial Sequence
  siRNA antisense sequence
aucuaaugguacagugugc

SEQ ID NO: 3167 - RNA, 19 nt, Artificial Sequence
  siRNA sense sequence
cacacuguaccauuagaug

SEQ ID NO: 3168 - RNA, 19 nt, Artificial Sequence
  siRNA antisense sequence
caucuaaugguacagugug

SEQ ID NO: 3169 - RNA, 19 nt, Artificial Sequence
  siRNA sense sequence
acacuguaccauuagauga

SEQ ID NO: 3170 - RNA, 19 nt, Artificial Sequence
  siRNA antisense sequence
ucaucuaaugguacagugu

SEQ ID NO: 3171 - RNA, 19 nt, Artificial Sequence
  siRNA sense sequence
cacuguaccauuagaugaa

SEQ ID NO: 3172 - RNA, 19 nt, Artificial Sequence
  siRNA antisense sequence
uucaucuaaugguacagug

SEQ ID NO: 3173 - RNA, 19 nt, Artificial Sequence
  siRNA sense sequence
aauugccauaagccauauu

SEQ ID NO: 3174 - RNA, 19 nt, Artificial Sequence
  siRNA antisense sequence
aauauggcuuauggcaauu

SEQ ID NO: 3175 - RNA, 19 nt, Artificial Sequence
  siRNA sense sequence
auugccauaagccauauua

SEQ ID NO: 3176 - RNA, 19 nt, Artificial Sequence
  siRNA antisense sequence
uaauauggcuuauggcaau

SEQ ID NO: 3177 - RNA, 19 nt, Artificial Sequence
  siRNA sense sequence
uugccauaagccauauuac

SEQ ID NO: 3178 - RNA, 19 nt, Artificial Sequence
  siRNA antisense sequence
guaauauggcuuauggcaa

SEQ ID NO: 3179 - RNA, 19 nt, Artificial Sequence
  siRNA sense sequence
ugccauaagccauauuaca

SEQ ID NO: 3180 - RNA, 19 nt, Artificial Sequence
  siRNA antisense sequence
uguaauauggcuuauggca

SEQ ID NO: 3181 - RNA, 19 nt, Artificial Sequence
  siRNA sense sequence
gccauaagccauauuacag

SEQ ID NO: 3182 - RNA, 19 nt, Artificial Sequence
  siRNA antisense sequence
cuguaauauggcuuauggc

SEQ ID NO: 3183 - RNA, 19 nt, Artificial Sequence
  siRNA sense sequence
ccauaagccauauuacaga

SEQ ID NO: 3184 - RNA, 19 nt, Artificial Sequence
  siRNA antisense sequence
ucuguaauauggcuuaugg

SEQ ID NO: 3185 - RNA, 19 nt, Artificial Sequence
  siRNA sense sequence
cauaagccauauuacagau

SEQ ID NO: 3186 - RNA, 19 nt, Artificial Sequence
  siRNA antisense sequence
aucuguaauauggcuuaug

SEQ ID NO: 3187 - RNA, 19 nt, Artificial Sequence
  siRNA sense sequence
uaagccauauuacagaucu

SEQ ID NO: 3188 - RNA, 19 nt, Artificial Sequence
  siRNA antisense sequence
agaucuguaauauggcuua

SEQ ID NO: 3189 - RNA, 19 nt, Artificial Sequence
  siRNA sense sequence
aagccauauuacagaucuu

SEQ ID NO: 3190 - RNA, 19 nt, Artificial Sequence
  siRNA antisense sequence
aagaucuguaauauggcuu

SEQ ID NO: 3191 - RNA, 19 nt, Artificial Sequence
  siRNA sense sequence
agccauauuacagaucuua

SEQ ID NO: 3192 - RNA, 19 nt, Artificial Sequence
  siRNA antisense sequence
uaagaucuguaauauggcu

SEQ ID NO: 3193 - RNA, 19 nt, Artificial Sequence
  siRNA sense sequence
gccauauuacagaucuuac

SEQ ID NO: 3194 - RNA, 19 nt, Artificial Sequence
  siRNA antisense sequence
guaagaucuguaauauggc

SEQ ID NO: 3195 - RNA, 19 nt, Artificial Sequence
  siRNA sense sequence
ccauauuacagaucuuacu

SEQ ID NO: 3196 - RNA, 19 nt, Artificial Sequence
  siRNA antisense sequence
aguaagaucuguaauaugg

SEQ ID NO: 3197 - RNA, 19 nt, Artificial Sequence
  siRNA sense sequence
uuuuaaagccgcugguacu

SEQ ID NO: 3198 - RNA, 19 nt, Artificial Sequence
  siRNA antisense sequence
aguaccagcggcuuuaaaa

SEQ ID NO: 3199 - RNA, 19 nt, Artificial Sequence
  siRNA sense sequence
uuuaaagccgcugguacua

SEQ ID NO: 3200 - RNA, 19 nt, Artificial Sequence
  siRNA antisense sequence
uaguaccagcggcuuuaaa

SEQ ID NO: 3201 - RNA, 19 nt, Artificial Sequence
  siRNA sense sequence
aaugcuauaucuauguacc

SEQ ID NO: 3202 - RNA, 19 nt, Artificial Sequence
  siRNA antisense sequence
gguacauagauauagcauu

SEQ ID NO: 3203 - RNA, 19 nt, Artificial Sequence
  siRNA sense sequence
augcuauaucuauguaccu

SEQ ID NO: 3204 - RNA, 19 nt, Artificial Sequence
  siRNA antisense sequence
agguacauagauauagcau

SEQ ID NO: 3205 - RNA, 19 nt, Artificial Sequence
  siRNA sense sequence
ugcuauaucuauguaccua

SEQ ID NO: 3206 - RNA, 19 nt, Artificial Sequence
  siRNA antisense sequence
uagguacauagauauagca

SEQ ID NO: 3207 - RNA, 19 nt, Artificial Sequence
  siRNA sense sequence
gcuauaucuauguaccuac

SEQ ID NO: 3208 - RNA, 19 nt, Artificial Sequence
  siRNA antisense sequence
guagguacauagauauagc

SEQ ID NO: 3209 - RNA, 19 nt, Artificial Sequence
  siRNA sense sequence
cuauaucuauguaccuacu

SEQ ID NO: 3210 - RNA, 19 nt, Artificial Sequence
  siRNA antisense sequence
aguagguacauagauauag

What is claimed is:

1. A method of treating a human subject having a liver disease or type 2 diabetes, the method comprising administering a Phosphodiesterase 3B (PDE3B) inhibitor to the subject,
    wherein the PDE3B inhibitor comprises an antisense nucleic acid molecule, a small interfering RNA (siRNA), or a short hairpin RNA (shRNA) that hybridizes to a PDE3B mRNA, and
    wherein the subject is PDE3B reference or heterozygous for a PDE3B predicted loss-of-function or missense variant nucleic acid molecule.

2. The method according to claim 1, wherein the liver disease is a fatty liver disease, hepatocellular carcinoma, liver cirrhosis, liver fibrosis, simple steatosis, steatohepatitis, or non-alcoholic steatohepatitis (NASH).

3. The method according to claim 2, wherein the fatty liver disease is alcoholic fatty liver disease (AFLD) or nonalcoholic fatty liver disease (NAFLD).

4. The method according to claim 1, wherein when the subject is PDE3B reference or when the subject is heterozygous for a PDE3B predicted loss-of-function or missense variant, the subject is also administered a therapeutic agent that treats or inhibits a liver disease or type 2 diabetes.

5. The method according to claim 1, wherein the PDE3B predicted loss-of-function or missense variant nucleic acid molecule is a splice-site variant, a stop-gain variant, a start-loss variant, a stop-loss variant, a frameshift variant, or an in-frame indel variant, or a variant that encodes a truncated PDE3B polypeptide.

6. The method according to claim 5, wherein the PDE3B predicted loss-of-function or missense variant nucleic acid molecule encodes a truncated PDE3B polypeptide.

7. A method of treating a human subject with a therapeutic agent that treats or inhibits a liver disease or type 2 diabetes, wherein the subject is suffering from a liver disease or type 2 diabetes, the method comprising the steps of:
   determining whether the subject has a Phosphodiesterase 3B (PDE3B) predicted loss-of-function or missense variant nucleic acid molecule encoding a human PDE3B polypeptide by:
      obtaining or having obtained a biological sample from the subject; and
      performing or having performed a sequence analysis on the biological sample to determine if the subject has a genotype comprising the PDE3B predicted loss-of-function or missense variant nucleic acid molecule; and
   when the subject is PDE3B reference, then administering or continuing to administer to the subject the therapeutic agent that treats or inhibits the liver disease or type 2 diabetes in an amount that is greater than a standard dosage amount, and administering to the subject a PDE3B inhibitor; and
   when the subject is heterozygous for a PDE3B predicted loss-of-function or missense variant nucleic acid molecule, then administering or continuing to administer to the subject the therapeutic agent that treats or inhibits the liver disease or type 2 diabetes in an amount that is the same as or less than a standard dosage amount, and administering to the subject a PDE3B inhibitor;
   when the subject is homozygous for a PDE3B predicted loss-of-function or missense variant nucleic acid molecule, then administering or continuing to administer to the subject the therapeutic agent that treats or inhibits the liver disease or type 2 diabetes in an amount that is the same as or less than a standard dosage amount;
   wherein the presence of a genotype having the PDE3B predicted loss-of-function or missense variant nucleic acid molecule encoding the human PDE3B polypeptide indicates the subject has a decreased risk of developing the liver disease or type 2 diabetes; and
   wherein the PDE3B inhibitor comprises an antisense nucleic acid molecule, a small interfering RNA (siRNA), or a short hairpin RNA (shRNA) that hybridizes to a PDE3B mRNA.

8. The method according to claim 7, wherein the subject is PDE3B reference, and the subject is administered or continued to be administered the therapeutic agent that treats or inhibits the liver disease or type 2 diabetes in an amount that is greater than a standard dosage amount, and is administered a PDE3B inhibitor.

9. The method according to claim 7, wherein the subject is heterozygous for a PDE3B predicted loss-of-function or missense variant, and the subject is administered or continued to be administered the therapeutic agent that treats or inhibits the liver disease or type 2 diabetes in an amount that is the same as or less than a standard dosage amount, and is administered a PDE3B inhibitor.

10. The method according to claim 7, wherein the predicted loss-of-function or missense variant PDE3B nucleic acid molecule is a splice-site variant, a stop-gain variant, a start-loss variant, a stop-loss variant, a frameshift variant, or an in-frame indel variant, or a variant that encodes a truncated PDE3B polypeptide.

11. The method according to claim 7, wherein the predicted loss-of-function or missense variant PDE3B nucleic acid molecule encodes a truncated PDE3B polypeptide.

12. The method according to claim 7, wherein the therapeutic agent for treating type 2 diabetes is chosen from metformin, insulin, glyburide, glipizide, glimepiride, repaglinide, nateglinide, rosiglitazone pioglitazone, sitagliptin, saxagliptin, linagliptin, exenatide, liraglutide, semaglutide, canagliflozin, dapagliflozin, and empagliflozin, or any combination thereof.

13. The method according to claim 7, wherein the therapeutic agent for treating liver disease is chosen from disulfiram, naltrexone, acamprosate, prednisone, azathioprine, an interferon, a protease inhibitor, a reverse transcriptase inhibitor, penicillamine, trientine, deferoxamine, bumetanide, furosemide, hydrochlorothiazide, chlorothiazide, amiloride, triamterene, spironolactone, atenolol, metoprolol, nadolol, propranolol, timolol, and carvedilol, or any combination thereof.

14. The method according to claim 7, wherein the liver disease is steatosis, steatohepatitis, or NASH, and the therapeutic agent is chosen from obeticholic acid, selonsertib, elafibranor, cenicriviroc, GR-MD-02, MGL-3196, IMM-124E, arachidyl amido cholanoic acid, GS-0976, emricasan, volixibat, NGM282, GS-9674, tropifexor, MN-001, LMB763, BI-1467335, MSDC-0602, PF-05221304, saroglitazar, BMS-986036, lanifibranor, semaglutide, nitazoxanide, GRI-0621, EYP001, VK2809, nalmefene, LIK066, MT-3995, elobixibat, namodenoson, foralumab, SAR425899, sotagliflozin, EDP-305, isosabutate, gemcabene, TERN-101, KBP-042, PF-06865571, DUR-928, PF-06835919, NGM313, BMS-986171, namacizumab, CER-209, ND-L02-s0201, RTU-1096, DRX-065, IONIS-DGAT2Rx, INT-767, NC-001, seladepar, PXL770, TERN-201, NV556, AZD2693, SP-1373, VK0214, TGFTX4, RLBN1127, GKT137831, RYI-018, CB4209, CB4211, and JH-0920, or any combination thereof.

* * * * *